US007638288B2

(12) United States Patent
Van Rompaey et al.

(10) Patent No.: US 7,638,288 B2
(45) Date of Patent: Dec. 29, 2009

(54) METHODS FOR INDUCING DIFFERENTIATION OF UNDIFFERENTIATED MAMMALIAN CELLS INTO OSTEOBLASTS

(75) Inventors: Luc Juliaan Corina Van Rompaey, Keergergen (BE); Peter Herwig Maria Tomme, Ghent (BE); Robin John Brown, Quarrendon (GB)

(73) Assignee: Galapagos N.V., Mechelen (BE)

( * ) Notice: Subject to any disclaimer, the term of this patent is extended or adjusted under 35 U.S.C. 154(b) by 72 days.

(21) Appl. No.: 11/478,193

(22) Filed: Jun. 29, 2006

(65) Prior Publication Data

US 2007/0031940 A1 Feb. 8, 2007

Related U.S. Application Data

(63) Continuation-in-part of application No. PCT/EP2004/014885, filed on Dec. 29, 2004.

(51) Int. Cl.
*G01N 33/53* (2006.01)
*C12Q 1/70* (2006.01)
(52) U.S. Cl. .................. 435/7.2; 435/4; 435/7.1; 506/7; 530/350; 530/325; 530/324
(58) Field of Classification Search .............. 435/7.2, 435/7.1, 4; 506/7; 530/350, 325
See application file for complete search history.

(56) References Cited

U.S. PATENT DOCUMENTS

| 6,340,595 | B1 | 1/2002 | Vogels et al. | |
|---|---|---|---|---|
| 7,192,583 | B2 * | 3/2007 | Brunkow et al. | 424/139.1 |
| 2003/0180258 | A1 | 9/2003 | van Es et al. | |
| 2003/0186360 | A1 * | 10/2003 | Feder et al. | 435/69.1 |
| 2003/0198627 | A1 | 10/2003 | Arts et al. | |
| 2004/0071660 | A1 | 4/2004 | Havenga et al. | |
| 2004/0101818 | A1 * | 5/2004 | Ji et al. | 435/4 |
| 2006/0252045 | A1 * | 11/2006 | Chatterjee-Kishore et al. | 435/6 |

FOREIGN PATENT DOCUMENTS

| WO | WO0177172 | A2 | 10/2001 |
|---|---|---|---|
| WO | WO03012070 | A2 | 2/2003 |
| WO | WO03018799 | A2 | 3/2003 |
| WO | WO03099867 | A1 | 12/2003 |
| WO | WO2004094636 | A1 | 11/2004 |
| WO | WO2005063976 | A2 | 7/2005 |
| WO | WO2005063983 | A1 | 7/2005 |

OTHER PUBLICATIONS

Arts, Gert-Jan., et al; "Adenoviral Vectors Expressing siRNAs for Discovery and Validation of Gene Function"; Genome Research, vol. 13, No. 10, pp. 2325-2332 (2003) Cold Spring Harbor Laboratory Press USA.

Brummelkamp, Thijn R., et al.; "Loss of the cylindromatosis tumour suppressor inhibits apoptosis by activating NF-kappaB"; Nature (London), vol. 424, No. 6950, pp. 797-801 (2003) Nature Publishing Group, London UK.

Franceschi, RT and Xiao, G.; "Regulation of the Osteoblast-Specific Transcription Factor, Runx2: Responsiveness to Multiple Signal Transduction Pathways", Journal of Cellular Biochemistry 88:446-454 (2003) Wiley-Liss, Inc. USA.

Golde, B.; "New Clues into the Etiology of Osteoporosis: The Effects of Prostaglandins (E2 and F2a) on Bone"; Medical Hypotheses, vol. 38, No. 2, pp. 125-131 (1992) Elsevier Science ltd. Publishers USA.

Harris, S.E., et al; "Effects of Transforming Growth Factor B on Bone Nodule Formation and Expression of Bone Morphogenetic Protein 2, Osteocalcin, Osteopontin, Alkaline Phosphatase, and Type I Collagen mRNA in Long-Term Cultures of Fetal Rate Calvarial Osteoblasts"; Journal of Bone and Mineral Research, vol. 9, No. 6, pp. 855-863 (1994) Mary Ann Liebert, Inc. Publishers USA.

Marzia, M., et al; "Decreased c-SCR Expression Enhances Osteoblast Differentiation and Bone Formation"; The Journal of Cell Biology, vol. 151, No. 2 pp. 311-320 (2000) The Rockefeller University Press USA.

Michiels, Frits, et al., "Arrayed adenoviral expression libraries for functional screening"; Nature Biotechnology, vol. 20, No. 11, pp. 154-1157 (2002) Nature Publishing Group USA.

Mundy, Gregory R., M.D.; "Cytokines and Growth Factors in the Regulation of Bone Remodeling"; Journal of Bone and Mineral Research, vol. 8, Suppl. 2, pp. S505-S510 (1993) Mary Ann Liebert, Inc. Publishers USA.

Mundy, Gregory R., M.D.; "Role of LCytokines in Bone Resorption"; Journal of Cellular Biochemistry, vol. 53 pp. 296-300 (1993) Wiley-Liss, Inc. USA.

Mundy, Gregory R., M.D., "Regulation of Bone Formation by Bone Morphogenetic Proteins and Other Growth Factors"; Clinical Orthopaedic and Related Research, No. 323, pp. 24-28 (1996) Lippinoctt-Raven Publishers USA.

Nakashima, K. and de Crombrugghe, B., "Transcriptional Mechanisms in Osteoblast Differentiation and Bone Formation"; Trends in Genetics, vol. 19, No. 8 pp. 458-466 (2003) Elsevier Ltd USA.

Service, Robert F., "Tissue Engineers Build New Bone"; Science Magazine, vol. 289, No. 5484, pp. 1498-1500 (2000) USA.

Sloper-Mould, Katherine E., et al., "Characterization and Chromosomal Localization of USP3, a Novel Human Ubiquitin-Specific Protease"; Journal of Biological Chemistry, vol. 274, No. 38, pp. 26878-26884 (1999) The American Society for Biochemistry & Molecular Biology, Inc. USA.

Stein, et al., "Relationship of cell growth to the regulation of tissue-specific gene expression during osteoblast differentiation"; Cell Growth and Gene Expression, The FASEB Journal, vol. 4, pp. 3111-3123 (1990) USA.

(Continued)

*Primary Examiner*—T. D. Wessendorf
(74) *Attorney, Agent, or Firm*—Martin Savitzky

(57) ABSTRACT

The present invention relates to in vivo and in vitro methods, agents and compound screening assays for inducing differentiation of undifferentiated mammalian cells into osteoblasts, including bone formation enhancing pharmaceutical compositions, and the use thereof in treating and/or preventing a disease involving a systemic or local decrease in mean bone density in a subject.

5 Claims, 11 Drawing Sheets

OTHER PUBLICATIONS

Thirunavukkarasu, et al., The Osteoblast-specific Transcription Factor Cbfa1 Contributes to the Expression of Osteoprotegerin, a Potent Inhibitor of Osteoclast Differentiation and Function, The Journal of Biological Chemistry, vol. 275, No. 3, pp. 25163-25172 (2000) JBC Papers in Press USA.

Yamada, et al.; Regulation of osteoclast development by Notch signaling directed to osteoclast precursors and through stromal cells; Blood, vol. 101, No. 6, pp. 2227-2234 (2003) The American Society of Hematology USA.

Zang, et al., "A RUNX2/PEBP/2alphaA/CBFAI mutuation displaying impaired transactivation and Smad interaction in cleidocranial dysplasia"; PNAS, vol. 97, No. 19, pp. 10549-10554 (2000) Proc. Natl. Acad. Sci USA.

* cited by examiner

| Lay out disease specific control plate | | | | | | | | | | | | |
|---|---|---|---|---|---|---|---|---|---|---|---|---|
| 96 well plate | | | | | | | | | | | | |
| | P1 | N1 | P2 | N2 | P3 | N3 | P1 | N1 | P2 | N2 | P3 | N3 |
| | N1 | P2 | N2 | P3 | N3 | P1 | N1 | P2 | N2 | P3 | N3 | P1 |
| | P2 | N2 | P3 | N3 | P1 | N1 | P2 | N2 | P3 | N3 | P1 | N1 |
| | N2 | P3 | N3 | P1 | N1 | P2 | N2 | P3 | N3 | P1 | N1 | P2 |
| | P3 | N3 | P1 | N1 | P2 | N2 | P3 | N3 | P1 | N1 | P2 | N2 |
| | N3 | P1 | N1 | P2 | N2 | P3 | N3 | P1 | N1 | P2 | N2 | P3 |
| | P1 | N1 | P2 | N2 | P3 | N3 | P1 | N1 | P2 | N2 | P3 | N3 |
| | N1 | P2 | N2 | P3 | N3 | P1 | N1 | P2 | N2 | P3 | N3 | P1 |

| P1: H9 | GC-143-193 | | N1: eGFP | Ad5C01AttO1/A1501_00/eGFP.idx.124#32KD GC-143-192 |
|---|---|---|---|---|
| | | | box27 | |
| P2: HTT | GC-143-193 | | N2: M6PR | Ad5C01AttO1/A1501_00/M6PR_v1 GC-143-192 |
| | | | box27 | |
| P3: eGFP | GC-143-186 | | N3: luc | Ad5C01AttO1/A1502_00/luc_v13 GC-143-192 |
| | | | box27 | |

Figure 3

| 384 well plate prepared from 1 96 well plate and 1 plate with medium | | | | | | | | | | | | | | | | | | | | | | | |
|---|---|---|---|---|---|---|---|---|---|---|---|---|---|---|---|---|---|---|---|---|---|---|---|
| This plate is used as source plate for screening | | | | | | | | | | | | | | | | | | | | | | | |
| P1 | P1 | N1 | N1 | P2 | P2 | N2 | N2 | P3 | P3 | N3 | N3 | P1 | P1 | N1 | N1 | P2 | P2 | N2 | N2 | P3 | P3 | N3 | N3 |
| P1 |    | N1 |    | P2 |    | N2 |    | P3 |    | N3 |    | P1 |    | N1 |    | P2 |    | N2 |    | P3 |    | N3 |    |
| N1 | N1 | P2 | P2 | N2 | N2 | P3 | P3 | N3 | N3 | P1 | P1 | N1 | N1 | P2 | P2 | N2 | N2 | P3 | P3 | N3 | N3 | P1 | P1 |
| N1 |    | P2 |    | N2 |    | P3 |    | N3 |    | P1 |    | N1 |    | P2 |    | N2 |    | P3 |    | N3 |    | P1 |    |
| P2 | P2 | N2 | N2 | P3 | P3 | N3 | N3 | P1 | P1 | N1 | N1 | P2 | P2 | N2 | N2 | P3 | P3 | N3 | N3 | P1 | P1 | N1 | N1 |
| P2 |    | N2 |    | P3 |    | N3 |    | P1 |    | N1 |    | P2 |    | N2 |    | P3 |    | N3 |    | P1 |    | N1 |    |
| N2 | N2 | P3 | P3 | N3 | N3 | P1 | P1 | N1 | N1 | P2 | P2 | N2 | N2 | P3 | P3 | N3 | N3 | P1 | P1 | N1 | N1 | P2 | P2 |
| N2 |    | P3 |    | N3 |    | P1 |    | N1 |    | P2 |    | N2 |    | P3 |    | N3 |    | P1 |    | N1 |    | P2 |    |
| P3 | P3 | N3 | N3 | P1 | P1 | N1 | N1 | P2 | P2 | N2 | N2 | P3 | P3 | N3 | N3 | P1 | P1 | N1 | N1 | P2 | P2 | N2 | N2 |
| P3 |    | N3 |    | P1 |    | N1 |    | P2 |    | N2 |    | P3 |    | N3 |    | P1 |    | N1 |    | P2 |    | N2 |    |
| N3 | N3 | P1 | P1 | N1 | N1 | P2 | P2 | N2 | N2 | P3 | P3 | N3 | N3 | P1 | P1 | N1 | N1 | P2 | P2 | N2 | N2 | P3 | P3 |
| N3 |    | P1 |    | N1 |    | P2 |    | N2 |    | P3 |    | N3 |    | P1 |    | N1 |    | P2 |    | N2 |    | P3 |    |
| P1 | P1 | N1 | N1 | P2 | P2 | N2 | N2 | P3 | P3 | N3 | N3 | P1 | P1 | N1 | N1 | P2 | P2 | N2 | N2 | P3 | P3 | N3 | N3 |
| P1 |    | N1 |    | P2 |    | N2 |    | P3 |    | N3 |    | P1 |    | N1 |    | P2 |    | N2 |    | P3 |    | N3 |    |
| N1 | N1 | P2 | P2 | N2 | N2 | P3 | P3 | N3 | N3 | P1 | P1 | N1 | N1 | P2 | P2 | N2 | N2 | P3 | P3 | N3 | N3 | P1 | P1 |
| N1 |    | P2 |    | N2 |    | P3 |    | N3 |    | P1 |    | N1 |    | P2 |    | N2 |    | P3 |    | N3 |    | P1 |    |

| P1: H9 | | | | N1: eGFP | |
|---|---|---|---|---|---|
|  |  |  |  |  |  |
| P2: T0 | | | | N2: M6PR | |
|  |  |  |  |  |  |
| P3: eGFP | | | | N3: luciferase | |

Figure 4

|   | Average | Standard deviation | cutoff (=mean (N1-3) + 3 x SD (N1-3)) | % positive |
|---|---|---|---|---|
| P1 | 20320 | 5018 |  | 98 |
| P2 | 21063 | 3138 |  | 100 |
| P3 | 2738 | 600 |  | 0 |
| N1 | 2940 | 1584 |  | 4 |
| N2 | 3565 | 1268 |  | 2 |
| N3 | 3385 | 962 |  | 0 |
| Blanco | 3707 | 1118 |  | 1 |
| All negatives | 3297 | 1314 | 7239 |  |

P1: H9         N1: eGFP
P2: H10        N2: M6PR
P3: eGFP       N3: luciferase

A
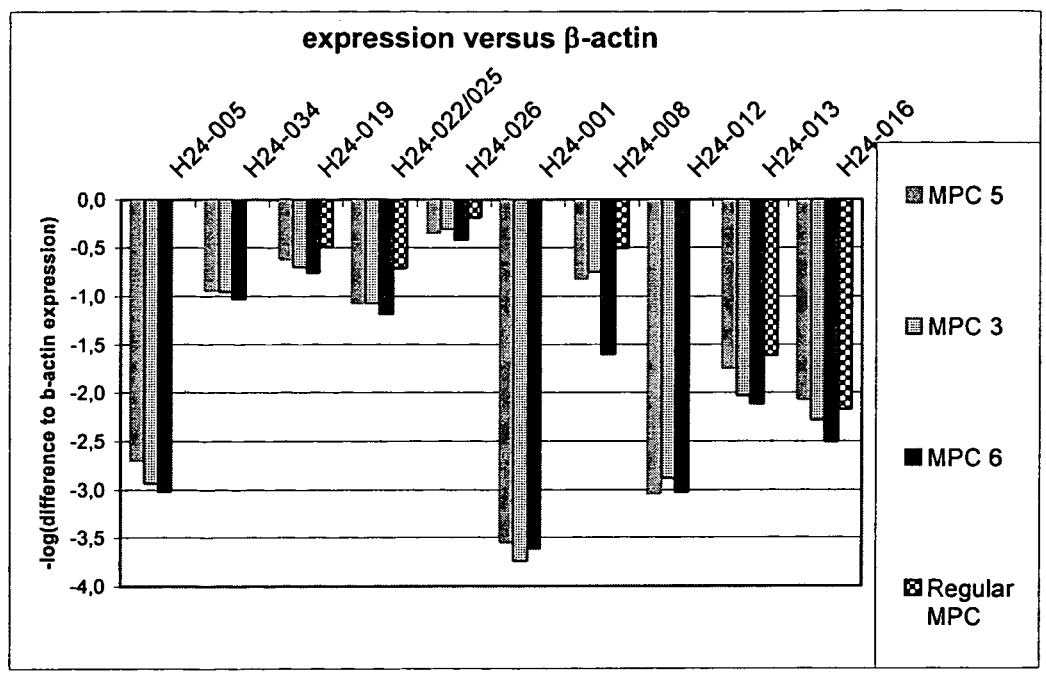
B
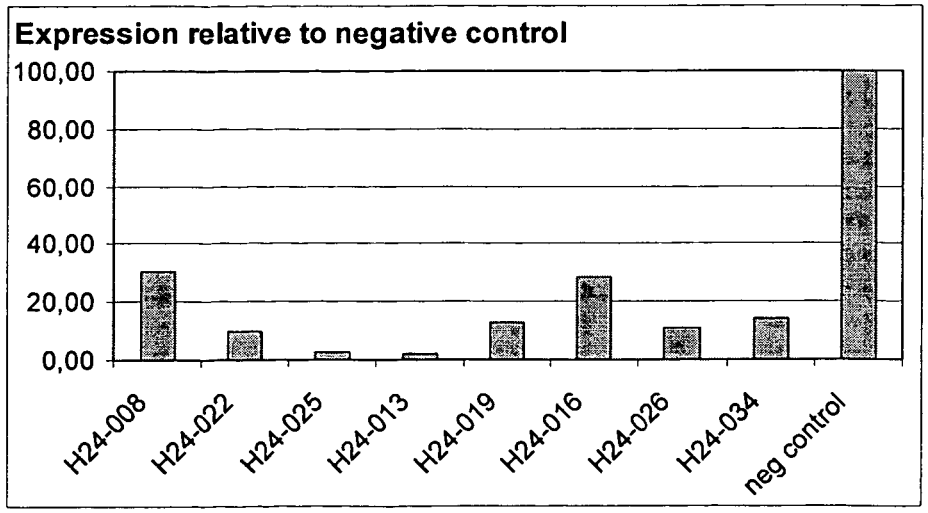
Figure 7

Ad5C01-eGFP (KI)  Ad5C01-BMP2
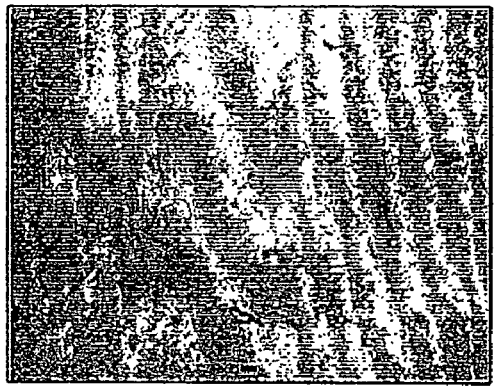
Knock-in
Ad5C01-H24-054  Ad5C01-eGFP (KD)
Knock-down
FIG. 10

METHODS FOR INDUCING DIFFERENTIATION OF UNDIFFERENTIATED MAMMALIAN CELLS INTO OSTEOBLASTS

CROSS-REFERENCE TO RELATED APPLICATIONS

This application is a continuation-in-part of PCT/EP2004/014885, filed Dec. 29, 2004, which claims priority to PCT/EP03/14994, filed Dec. 29, 2003, both of which applications designate the USA, the disclosures of which are incorporated herein by reference.

FIELD OF THE INVENTION

The present invention relates to agents, and methods for identifying compounds, which agents and compounds induce the differentiation of undifferentiated cells and/or osteoblast progenitor cells into osteoblasts. In addition, the invention relates to compositions and methods for the use thereof in limiting undesired bone loss in a vertebrate at risk of such bone loss, in treating conditions that are characterized by undesired bone loss or by the need for bone growth, in treating fractures, and in treating cartilage disorders.

Bone remodeling relies on an equilibrium between an anabolic (osteogenic) and a catabolic (bone resorption) process. Bone is a dynamic tissue that is continuously being destroyed (resorbed) and rebuilt, by an intricate interplay between two distinct cell lineages: bone-forming cells, known as osteoblasts and bone-resorbing cells, known as osteoclasts.

A number of diseases are the direct result of a disturbance in the fine-tuned balance between bone resorption and bone formation. These diseases for the most part are skeletal diseases and inflict a large number of patients. Exemplary diseases include hypocalcaemia of malignancy, Paget's disease, inflammatory bone diseases such as rheumatoid arthritis and periodontal disease, focal osteogenesis occurring during skeletal metastases, Crouzon's syndrome, rickets, opsismodysplasia, pycnodysostosis/Toulouse-Lautrec disease, and osteogenesis imperfecta. Of great significance are the chronic conditions of rheumatoid- and osteo-arthritis and osteoporosis, including age-related osteoporosis and osteoporosis associated with post-menopausal hormone status. Other conditions characterized by the need for bone growth include primary and secondary hyperparathyroidism, disuse osteoporosis, diabetes-related osteoporosis, and glucocorticoid-related osteoporosis. The single most prevalent bone disease is osteoporosis, which affects 1 in 5 women over 50 and 1 in 20 men over 50.

Other conditions that are characterized by the need to enhance bone formation include bone fractures, where it would be desirable to stimulate bone growth and to hasten and complete bone repair. Bone fractures are still treated exclusively using casts, braces, anchoring devices and other strictly mechanical means. Other bone deficit conditions include bone segmental defects, periodontal disease, metastatic bone disease, osteolytic bone disease and conditions where connective tissue repair would be beneficial, such as healing or regeneration of cartilage defects or injury. To treat all of these conditions, bone remodeling processes are required; however, in many instances, patients are encountered with poorly healing fractures or bone defects. Consequently, surgical intervention is often required to accelerate the recovery. Such surgery may implant a prosthesis with or without bone grafting procedures. In many cases where the bone is too porous or where previous implants failed to be incorporated into the bone, current medical practices can offer little or no help. There are currently no satisfactory pharmaceutical approaches to managing any of these conditions. While further bone deterioration associated with post-menopausal osteoporosis has been decreased or prevented with estrogens or bisphosphonates, current therapies do not build new bone to replace bone that has already deteriorated.

The activities of bone cells are regulated by a large number of cytokines and growth factors, many of which have now been identified and cloned. Mundy has described the current knowledge related to these factors (Mundy 1996: Mundy 1993). Although there is a great deal of information available on the factors which influence the breakdown and resorption of bone, information on factors which stimulate the formation of new bone is more limited.

The cascade of transcription factors and growth factors involved in the differentiation or progression from progenitor cell to functional osteoclast is well established. In contrast, little is known about the factors involved in the progression of progenitor cells into osteoblasts. The mesenchymal progenitor or stem cells (MPCs) represent the starting point for the differentiation of both osteoclasts and osteoblasts. During embryonic development in vivo, bone formation occurs through two distinct pathways: intramembranous and/or endochondral ossification (see FIG. 1; taken from Nakashima and de Crombrugghe, (2003)). During intramembranous ossification, flat bones such as those of the skull or clavicles, are formed directly from condensations of mesenchymal cells. During endochondral ossification, long bones, such as limb bones, are formed from a cartilage intermediate formed during mesenchymal condensation, which intermediate is invaded during further development by endothelial cells, osteoclasts and mesenchymal cells that further differentiate into osteoblasts and osteocytes. As osteoblasts differentiate from precursors to mature bone-forming cells, they express and secrete a number of enzymes and structural proteins of the bone matrix, including Type-1 collagen, osteocalcin, osteopontin and alkaline phosphatase (Stein et al 1990; Harris et al 1994). During the late stage of differentiation into osteoblasts, bone alkaline phosphatase activity (BAP) is up-regulated. Like alkaline phosphatase, osteocalcin and osteopontin, the BMPs are expressed by cultured osteoblasts as they proliferate and differentiate.

A limited number of compounds have been identified that are able to induce osteoblast differentiation in vitro, e.g., dexamethasone or by recombinant human secreted proteins, e.g., BMP-2 or BMP-7 (Service, 2000). BMPs are potent stimulators of bone formation in vitro and in vivo, however there are disadvantages to their use as therapeutic agents to enhance bone healing. Receptors for the bone morphogenetic proteins have been identified in many tissues, and the BMPs themselves are expressed in a large variety of tissues in specific temporal and spatial patterns. This suggests that BMPs may have effects on many tissues other than bone, potentially limiting their usefulness as therapeutic agents when administered systemically.

It is therefore important to identify agents that can induce osteoblast differentiation starting from pluripotent bone marrow mesenchymal progenitor cells or even from totipotent stem cells. Therefore, research has expanded into the identification of human secreted proteins and human receptor or mediator TARGETs that are involved in the specific modulation of differentiation of osteoblasts or of other cell types involved in bone homeostasis.

Reported Developments

A number of treatments have been developed and made available to patients suffering from osteoporosis and related skeletal diseases. These therapeutic approaches primarily are directed to increasing net bone formation and include: hormone replacement therapy (HRT); selective estrogen receptor modulators (SERMs); bisphosphonates; and calcitonin. While these treatments slow down bone resorption, they don't abolish fracturing because the lost bone is not sufficiently replenished. Fracturing will be prevented only if bone formation is sufficiently increased. Therefore, there is great interest in identifying osteogenic pathways that enhance bone anabolism as a basis for therapeutic intervention.

Parathyroid hormone (PTH) 1-34 is the only bone anabolic therapy on the osteoporosis therapeutic market. While PTH displays bone anabolic effects when administered intermittently, it needs to be injected daily, and may have tumorgenic side effects, based on the observation that tumors form in animals treated with at PTH in high doses.

Bone morphogenetic proteins (BMPs) are another class of bone anabolic therapeutics, but have only been approved for niche markets. Receptors for the bone morphogenetic proteins have been identified in many tissues other than bone, and BMPs themselves are expressed in a large variety of tissues in specific temporal and spatial patterns. This suggests that BMPs may have effects on many tissues other than bone, potentially limiting their usefulness as therapeutic agents when administered systemically.

There is a clear need to identify additional targets that stimulate osteogenic differentiation and that can be used for the development of novel bone anabolic therapies.

The present invention relates to the relationship between the function of selected proteins identified by the present inventors (hereinafter referred to as "TARGETS") and osteoblast differentiation in vertebrate cells.

SUMMARY OF THE INVENTION

The present invention relates to a method for identifying compounds that induce differentiation of undifferentiated vertebrate cells into osteoblasts, comprising contacting the compound with a polypeptide comprising an amino acid sequence selected from the group consisting of SEQ ID NO: 377-599, 601-606, 867-1119, 1123-1133 under conditions that allow said polypeptide to bind to the compound, and measuring a compound-polypeptide property related to the differentiation of said cells into osteoblasts.

The present invention also relates to expression inhibitory agents, pharmaceutical compositions comprising the same, methods for the in vitro production of bone tissue, and host cells expressing said agents.

Aspects of the present method include the in vitro assay of compounds using polypeptide of a TARGET, and cellular assays wherein TARGET inhibition is followed by observing indicators of efficacy, including bone alkaline phosphatase secretion levels.

Another aspect of the invention is a method of treatment or prevention of a condition involving loss of bone density, in a subject suffering or susceptible thereto, by administering a pharmaceutical composition comprising an effective bone formation enhancing amount of a TARGET inhibitor.

A further aspect of the present invention is a pharmaceutical composition for use in said method wherein said inhibitor comprises a polynucleotide selected from the group of an antisense polynucleotide, a ribozyme, and a small interfering RNA (siRNA), wherein said inhibitor comprises a nucleic acid sequence complementary to, or engineered from, a naturally occurring polynucleotide sequence encoding a polypeptide, comprising an amino acid sequence selected from the group consisting of SEQ ID NO: 377-418, 601, 867-1119, 1123-1133, or a fragment thereof.

Another further aspect of the present invention is a pharmaceutical composition comprising a therapeutically effective bone formation-enhancing amount of a TARGET inhibitor or its pharmaceutically acceptable salt, hydrate, solvate, or prodrug thereof in admixture with a pharmaceutically acceptable carrier. The present polynucleotides and TARGET inhibitor compounds are also useful for the manufacturing of a medicament for the treatment of conditions involving bone density loss.

BRIEF DESCRIPTION OF THE FIGURES

FIG. 3. Lay-out of the 96 well knock-down control plate.
FIG. 4. Lay-out of the 384 well control plate.

DETAILED DESCRIPTION OF THE INVENTION

Figure 1:
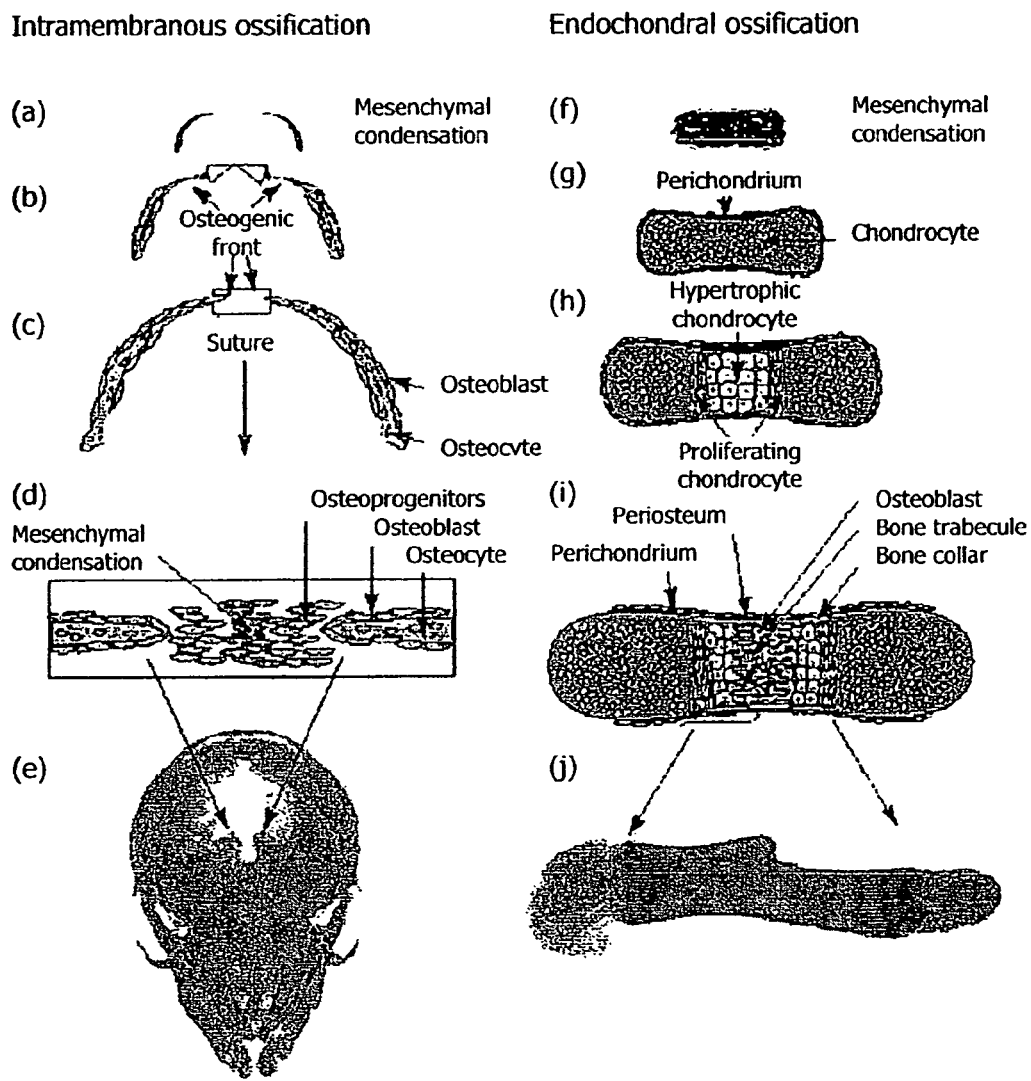
FIG. 1. Intramembranous and endochondral ossification.

The following terms are used herein in accordance with the following definitions:

The term "agent" means any molecule, including polypeptides, polynucleotides and small molecules.

The term "agonist" refers to a ligand that stimulates the receptor the ligand binds to in the broadest sense.

The term "assay" means any process used to measure a specific property of a compound. A "screening assay" means a process used to characterize or select compounds based upon their activity from a collection of compounds.

The term "binding affinity" is a property that describes how strongly two or more compounds associate with each other in a non-covalent relationship. Binding affinities can be characterized qualitatively, (such as "strong", "weak", "high", or "low") or quantitatively (such as measuring the $K_D$).

The term "carrier" means a non-toxic material used in the formulation of pharmaceutical compositions to provide a medium, bulk and/or useable form to a pharmaceutical composition. A carrier may comprise one or more of such materials such as an excipient, stabilizer, or an aqueous pH buffered solution. Examples of physiologically acceptable carriers include aqueous or solid buffer ingredients including phosphate, citrate, and other organic acids; antioxidants including ascorbic acid; low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, polyethylene glycol (PEG), and PLURONICS™.

The term "complex" means the entity created when two or more compounds bind to each other.

The term "compound" is used herein in the context of a "test compound" or a "drug candidate compound" described in connection with the assays of the present invention. As such, these compounds comprise organic or inorganic compounds, derived synthetically or from natural sources. The compounds include inorganic or organic compounds such as polynucleotides, lipids or hormone analogs that are characterized by relatively low molecular weights. Other biopolymeric organic test compounds include peptides comprising from about 2 to about 40 amino acids and larger polypeptides comprising from about 40 to about 500 amino acids, such as antibodies or antibody conjugates.

The term "condition" or "disease" means the overt presentation of symptoms (i.e., illness) or the manifestation of abnormal clinical indicators (e.g., biochemical indicators). Alternatively, the term "disease" refers to a genetic or environmental risk of or propensity for developing such symptoms or abnormal clinical indicators.

The term "contact" or "contacting" means bringing at least two moieties together, whether in an in vitro system or an in vivo system.

The term "effective amount" or "therapeutically effective amount" means that amount of a compound or agent that will elicit the biological or medical response of a subject that is being sought by a medical doctor or other clinician. In particular, with regard to inducing undifferentiated vertebrate cells into osteoblasts, the term "effective amount" is intended to mean an effective differentiation-promoting amount of an compound or agent that will bring about a biologically meaningful increase in the levels of osteogenic markers, representative for the process of differentiation into osteoblasts.

The term "endogenous" shall mean a material that a mammal naturally produces. Endogenous in reference to the term "protease", "kinase", or G-Protein Coupled Receptor ("GPCR") shall mean that which is naturally produced by a mammal (for example, and not limitation, a human). In contrast, the term non-endogenous in this context shall mean that which is not naturally produced by a mammal (for example, and not limitation, a human). Both terms can be utilized to describe both "in vivo" and "in vitro" systems. For example, and not a limitation, in a screening approach, the endogenous or non-endogenous TARGET may be in reference to an in vitro screening system. As a further example and not limitation, where the genome of a mammal has been manipulated to include a non-endogenous TARGET, screening of a candidate compound by means of an in vivo system is viable.

The term "expressible nucleic acid" means a nucleic acid coding for a proteinaceous molecule, an RNA molecule, or a DNA molecule.

The term "expression" comprises both endogenous expression and overexpression by transduction.

The term "expression inhibitory agent" means a polynucleotide designed to interfere selectively with the transcription, translation and/or expression of a specific polypeptide or protein normally expressed within a cell. More particularly, "expression inhibitory agent" comprises a DNA or RNA molecule that contains a nucleotide sequence identical to or complementary to at least about 17 sequential nucleotides within the polyribonucleotide sequence coding for a specific polypeptide or protein. Exemplary expression inhibitory molecules include ribozymes, double stranded siRNA molecules, self-complementary single-stranded siRNA molecules, genetic antisense constructs, and synthetic RNA antisense molecules with modified stabilized backbones.

The term "expressible nucleic acid" means a nucleic acid coding for a proteinaceous molecule, an RNA molecule, or a DNA molecule.

The term "GPCR" means a G-protein coupled receptor. Preferred GPCRs comprise those receptors identified by applicants as promoting osteogenic differentiation. Most preferred GPCRs are those identified in Tables 1 and 2, including the naturally occurring transcript variants thereof.

The term "hybridization" means any process by which a strand of nucleic acid binds with a complementary strand through base pairing. The term "hybridization complex" refers to a complex formed between two nucleic acid sequences by virtue of the formation of hydrogen bonds between complementary bases. A hybridization complex may be formed in solution (e.g., $C_{0t}$ or $R_{0t}$ analysis) or formed between one nucleic acid sequence present in solution and another nucleic acid sequence immobilized on a solid support (e.g., paper, membranes, filters, chips, pins or glass slides, or any other appropriate substrate to which cells or their nucleic acids have been fixed). The term "stringent conditions" refers to conditions that permit hybridization between polynucleotides and the claimed polynucleotides. Stringent conditions can be defined by salt concentration, the concentration of organic solvent, e.g., formamide, temperature, and other conditions well known in the art. In particular, reducing the concentration of salt, increasing the concentration of formamide, or raising the hybridization temperature can increase stringency.

The term "inhibit" or "inhibiting", in relationship to the term "response" means that a response is decreased or prevented in the presence of a compound as opposed to in the absence of the compound.

The term "inhibition" refers to the reduction, down regulation of a process or the elimination of a stimulus for a process that results in the absence or minimization of the expression of a protein or polypeptide.

The term "induction" refers to the inducing, up-regulation, or stimulation of a process that results in the expression of a protein or polypeptide.

The term "ligand" means an endogenous, naturally occurring molecule specific for an endogenous, naturally occurring receptor.

The term "osteoblast differentiation" means the process of differentiation of undifferentiated cells (progenitor cells or precursor cells) into osteoblasts and/or preosteoblasts. The term "osteogenesis" is used as a synonym in this context. "Abnormal osteoblast differentiation" means a situation where either too much or too little osteoblast differentiation is occurring.

The term "pharmaceutically acceptable prodrugs" as used herein means the prodrugs of the compounds useful in the present invention, which are, within the scope of sound medical judgment, suitable for use in contact with the tissues of patients with undue toxicity, irritation, allergic response commensurate with a reasonable benefit/risk ratio, and effective for their intended use of the compounds of the invention. The term "prodrug" means a compound that is transformed in vivo to yield an effective compound useful in the present invention or a pharmaceutically acceptable salt, hydrate or solvate thereof. The transformation may occur by various mechanisms, such as through hydrolysis in blood. The compounds bearing metabolically cleavable groups have the advantage that they may exhibit improved bioavailability as a result of enhanced solubility and/or rate of absorption conferred upon the parent compound by virtue of the presence of the metabolically cleavable group, thus, such compounds act as prodrugs. A thorough discussion is provided in Design of Prodrugs, H. Bundgaard, ed., Elsevier (1985); Methods in Enzymology; K. Widder et al, Ed., Academic Press, 42, 309-396 (1985); A Textbook of Drug Design and Development, Krogsgaard-Larsen and H. Bandaged, ed., Chapter 5; "Design and Applications of Prodrugs" 113-191 (1991); Advanced Drug Delivery Reviews, H. Bundgard, 8, 1-38, (1992); J. Pharm. Sci., 77,285 (1988); Chem. Pharm. Bull., N. Nakeya et al, 32, 692 (1984); Pro-drugs as Novel Delivery Systems, T. Higuchi and V. Stella, 14 A.C.S. Symposium Series, and Bioreversible Carriers in Drug Design, E. B. Roche, ed., American Pharmaceutical Association and Pergamon Press, 1987, which are incorporated herein by reference. An example of the prodrugs is an ester prodrug. "Ester prodrug" means a compound that is convertible in vivo by metabolic means (e.g., by hydrolysis) to an inhibitor compound according to the present invention. For example an ester prodrug of a compound containing a carboxy group may be convertible by hydrolysis in vivo to the corresponding carboxy group.

The term "pharmaceutically acceptable salts" refers to the non-toxic, inorganic and organic acid addition salts, and base addition salts, of compounds of the present invention. These salts can be prepared in situ during the final isolation and purification of compounds useful in the present invention.

The term "polynucleotide" refers to nucleic acids, such as double stranded, or single stranded DNA and (messenger) RNA, and all types of oligonucleotides. It also includes nucleic acids with modified backbones such as peptide nucleic acid (PNA), polysiloxane, and 2'-O-(2-methoxy)ethylphosphorothioate. "Derivatives of a polynucleotide" means DNA-molecules, RNA-molecules, and oligonucleotides that comprise a stretch or nucleic acid residues of the polynucleotide, e.g. polynucleotides that may have nucleic acid mutations as compared to the nucleic acid sequence of a naturally occurring form of the polynucleotide. A derivative may further comprise nucleic acids with modified backbones such as PNA, polysiloxane, and 2'-O-(2-methoxy)ethyl-phosphorothioate, non-naturally occurring nucleic acid residues, or one or more nucleic acid substituents, such as methyl-, thio-, sulphate, benzoyl-, phenyl-, amino-, propyl-, chloro-, and methanocarbanucleosides, or a reporter molecule to facilitate its detection. "Fragment of a polynucleotide" means oligonucleotides that comprise a stretch of contiguous nucleic acid residues that exhibit substantially a similar, but not necessarily identical, activity as the complete sequence.

The term "polypeptide" relates to proteins, proteinaceous molecules, fractions of proteins, peptides, oligopeptides, and enzymes (such as kinases, proteases, GCPRs). "Derivatives of a polypeptide" relate to those peptides, oligopeptides, polypeptides, proteins and enzymes that comprise a stretch of contiguous amino acid residues of the polypeptide and that retain the biological activity of the protein, e.g. polypeptides that have amino acid mutations compared to the amino acid sequence of a naturally-occurring form of the polypeptide. A derivative may further comprise additional naturally occurring, altered, glycosylated, acylated or non-naturally occurring amino acid residues compared to the amino acid sequence of a naturally occurring form of the polypeptide. It may also contain one or more non-amino acid substituents compared to the amino acid sequence of a naturally occurring form of the polypeptide, for example a reporter molecule or other ligand, covalently or non-covalently bound to the amino acid sequence. "Fragment of a polypeptide" relates to peptides, oligopeptides, polypeptides, proteins and enzymes that comprise a stretch of contiguous amino acid residues, and exhibit substantially similar, but not necessarily identical, functional activity as the complete sequence.

The term "SILENCESELECT® "indicates the registered US service mark of the assignee of the present application, and is a registered trademark outside the US, and describes drug discovery services, and products relating to drug discovery, including arrayed libraries consisting of shRNAs that can be used to knock-down human drugable targets.

The term "solvate" means a physical association of a compound useful in this invention with one or more solvent molecules. This physical association includes hydrogen bonding. In certain instances the solvate will be capable of isolation, for example when one or more solvent molecules are incorporated in the crystal lattice of the crystalline solid. "Solvate" encompasses both solution-phase and isolable solvates. Representative solvates include hydrates, ethanolates and methanolates.

The term "subject" includes humans and other mammals.

The term "treating" means an intervention performed with the intention of preventing the development or altering the pathology of, and thereby alleviating a disorder, disease or condition, including one or more symptoms of such disorder or condition. Accordingly, "treating" refers to both therapeutic treatment and prophylactic or preventative measures. Those in need of treating include those already with the disorder as well as those in which the disorder is to be prevented. The related term "treatment," as used herein, refers to the act of treating a disorder, symptom, disease or condition, as the term "treating" is defined above.

The term "undifferentiated mammalian cells" are pluripotent cells which are in an early stage of specialization, i.e. cells which do not yet have their final function and can be induced to form almost any given cell type. In particular, these are cells which have not yet differentiated to the specific bone cells osteoblasts or osteoclasts. Such pluripotent cells are especially blood cells and cells present in bone marrow, as well as cells derived from adipose tissue. In addition, cells which can be differentiated into mesenchymal precursor cells are contemplated in the present invention, such as, for example, totipotent stem cells such as embryonic stem cells.

The term "vectors" also relates to plasmids as well as to viral vectors, such as recombinant viruses, or the nucleic acid encoding the recombinant virus.

The term "vertebrate cells" means cells derived from animals having vertera structure, including fish, avian, reptilian, amphibian, marsupial, and mammalian species. Preferred cells are derived from mammalian species, and most preferred cells are human cells. Mammalian cells include feline, canine, bovine, equine, caprine, ovine, porcine murine, such as mice and rats, and rabbits.

Applicants' Invention Based on TARGET Relationship to Osteoblast Differentiation As noted above, the present invention is based on the present inventors' discovery that TARGETS are factors in the up-regulation and/or induction of osteoblast differentiation. The term "TARGET" or "TARGETS" means the proteins identified in accordance with the present bone alkaline phosphatase assay to be involved in the induction osteoblast differentiation. The TARGETS are identified in Table 1 by gene name, gene symbol, genbank DNA/RNA accession number, genbank polypeptide accession number, and their associated SEQ ID NOS. Table 1 also provides knock-down target sequences and their associated SEQ ID NOS of the present invention. Table 1A provides additional KD TARGET Sequences for the TARGETS identified in Table 1.

The preferred TARGETS are identified in Table 2 by gene name, gene symbol, genbank DNA/RNA accession number, genbank polypeptide accession number, and their associated SEQ ID NOS. Table 2 also provides knock-down target sequences and their associated SEQ ID NOS of the present invention. Table 2A identifies exemplary protein domain fragments of the preferred polypeptide TARGETS identified in Table 2.

TABLE 1

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-049 | GTACCTGC AGGTGCTC AGC | 1 | arginine vasopressin receptor 1B | AVPR1B | NM_000707 | 367 | NP_000698 | 409 |
| H24-225 | ATGGGCTT CAACAGCC ACC | 2 | arginine vasopressin receptor 1B | AVPR1B | NM_000707 | 367 | NP_000698 | 409 |
| H24-001 | CAACTTGT ACCTGGGC AGC | 3 | G protein-coupled receptor 38 | GPR38 | NM_001507 | 607 | NP_001498 | 867 |
| H24-002 | GGTGAAGG AGGTGCTG GAC | 4 | serine/threonine kinase 11 (Peutz-Jeghers syndrome) | STK11, LKB1 | NM_000455 | 608 | NP_000446 | 868 |
| H24-003 | GAATCTCT TCCGCAAG ATC | 5 | hypothetical protein MGC8407 | HSM801665, MGC8407 | AL136697 NM_024046 | 609 610 | AL136697's protein NP_076951 | 1123 869 |
| H24-004 | CATGCTGT TTGAGAGC ATC | 6 | MAP kinase-interacting serine/threonine kinase 2 | MKNK2, MNK2 | SK236 NM_017572 NM_199054 | 348 349 350 | SK236's protein NP_060042 NP_951009 | 390 391 392 |
| H24-005 | TTTGTGCT GATTCCAT GGC | 7 | calcitonin receptor-like | CALCRL | NM_005795 | 611 | NP_005786 | 870 |
| H24-006 | GACGGTGT TAATGATA GCC | 8 | casein kinase 1, gamma 1 | CSNK1G1, CK1g1 | NM_00101166 (SK647) NM_022048 | 356 357 | NP_001011664 NP_071331 | 398 399 |
| H24-007 | CTTCGGCA CTCCTGAG TTC | 9 | myosin light chain kinase | HSA247087, caMLCK, MLCK | SK536 NM_182493 (AJ247087) | 368 369 | SK536's protein NP_872299 | 410 411 |
| H24-008 | GCACAGTT TGAGAAGC AGC | 10 | Rho-associated, coiled-coil containing protein kinase 2 | ROCK2 | NM_004850 | 600 | NP_004841 | 601 |
| H24-009 | ACGCAAAG TGGCCAGG AGC | 11 | tRNA isopentenyl-transferase 1 | IPT | NM_017646 | 612 | NP_060116 | 871 |
| H24-010 | CGATGTGC CTTCAAGA TTC | 12 | protein kinase C, nu | PRKCN, PKD3 | NM_005813 SK489 | 613 614 | NP_005804 SK489's protein | 872 1124 |
| H24-011 | GTGCACGG ATTCAGAG AGC | 13 | membrane protein, palmitoylated 6 | MPP6 | NM_016447 | 615 | NP_057531 | 873 |
| H24-012; H24-161 | CTTCTACA CGTCCATG CTC | 14 | G protein-coupled receptor | TYMSTR | NM_006564 | 616 | NP_006555 | 874 |
| H24-013 | CAACCTGC TGGTGCTC GTC | 15 | opsin 3 (encephalopsin, panopsin) | OPN3 | NM_014322 | 617 | NP_055137 | 875 |
| H24-014 | CTCTCTTA GATCTGGA | 16 | granzyme K (serine | GZMK | NM_002104 | 362 | NP_002095 | 404 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| | ACC | | protease, granzyme 3; tryptase II) | | | | | |
| H24-015 | AGCAGGAAGGCGGACATAC | 17 | ubiquitin-specific protease 3 - ubiquitin specific protease 3 | AF073344, USP3 | NM_006537 | 618 | NP_006528 | 876 |
| H24-016 | CTCCAGCTGAGTGAGCAGC | 18 | L-fucose kinase | FUK | NM_145059 | 619 | NP_659496 | 877 |
| H24-017 | TAAACCAGCAGAGGAGCTC | 19 | hypothetical protein MGC26954 | MGC26954 | NM_145025 | 620 | NP_659462 | 878 |
| H24-018 | TCAGGTAGTTGGTTCTGAC | 20 | coagulation factor XIII, A1 polypeptide | F13A1 | NM_000129 | 621 | NP_000120 | 879 |
| H24-019 | CTGCGCCGAACAAATGTAC | 21 | proteasome (prosome, macropain) subunit, beta type, 3 | PSMB3 | NM_002795 | 622 | NP_002786 | 880 |
| H24-020 | TGTGGCGACTTGTGCACAC | 22 | ClpX caseinolytic protease X homolog (*E. coli*) | CLPX | NM_006660 | 623 | NP_006651 | 881 |
| H24-021 | TCTCTCAGTGTAGAATGCC | 23 | hypothetical protein FLJ14906 | C13orf6, FLJ14906 | NM_032859 | 353 | NP_116248 | 395 |
| H24-022 | CCAGGAGGTGAAACCACAC | 24 | HP43.8KD protein | HP43.8KD | NM_032557 | 624 | NP_115946 | 882 |
| H24-023 | TCAGGCGACTACTTTACTC | 25 | ubiquitin specific protease 9, X chromosome (fat facets-like *Drosophila*) | USP9X | NM_004652 NM_021906 | 625 626 | NP_004643 NP_068706 | 883 884 |
| H24-024 | GTGTACTGGTACAAGGACC | 26 | matrix metalloproteinase 23A-matrix metalloproteinase 23B | MMP23A, MMP23B | NM_004659 NM_006983 | 340 341 | NP_004650 NP_008914 | 382 383 |
| H24-025 | GAGCAGGTTTCCAAAGGAC | 27 | HP43.8KD protein | HP43.8KD | NM_032557 | 627 | NP_115946 | 885 |
| H24-026 | TCTCTCATCAATACTGGTC | 28 | APEX nuclease (multifunctional DNA repair enzyme) | APEX | NM_001641 NM_080648 NM_080649 | 628 629 630 | NP_001632 NP_542379 NP_542380 | 886 887 888 |
| H24-027 | TGCAGAGCAGACAAGTGGC | 29 | a disintegrin-like and metalloprotease (reprolysin type) with thrombospondin | ADAMTS19 | NM_133638 | 631 | NP_598377 | 889 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| | | | type 1 motif, 19 | | | | | |
| H24-028 | TCATGTTG ACCAAGCA AGC | 30 | a disintegrin and metalloprotein- ase domain 22 | ADAM22 | NM_004194 NM_016351 NM_021721 NM_021722 NM_021723 | 632 633 634 635 636 | NP_004185 NP_057435 NP_068367 NP_068368 NP_068369 | 890 891 892 893 894 |
| H24-029 | CTATGCCA TCACCTTC TGC | 31 | LOC254378 | LOC254378 | XM_174812 | 637 | XP_174812 | 895 |
| H24-030 | TGTGCCGA AGGATGTA AGC | 32 | similar to a disintegrin and metalloprotease domain 25 (testase 2) | LOC137491 | XM_070459 | 638 | XP_070459 | 896 |
| H24-031 | CCGGGACA TAACTAAA TCC | 33 | similar to bile salt-dependent lipase oncofetal isoform | LOC138529 | XM_070951 | 639 | XP_070951 | 897 |
| H24-032 | AGCAGGCT ATGGGATC AAC | 34 | complement component 9 | C9 | NM_001737 | 640 | NP_001728 | 898 |
| H24-033 | CCACAAGG TTGCAGCA TTC | 35 | xylulokinase homolog (*H. influenzae*) | XYLB | NM_005108 | 641 | NP_005099 | 899 |
| H24-035 | GGGCTCAG CCAGGAGA TTC | 36 | chaperone, ABC1 activity of bc1 complex like (*S. pombe*) | CABC1, ADCK3 | NM_020247 SK609 | 642 643 | NP_064632 SK609's protein | 900 |
| H24-036 | CAGGTAGA CATGGCGG CAC | 37 | fyn-related kinase | FRK | NM_002031 | 644 | NP_002022 | 901 |
| H24-037 | CTCTCCAG GACACTGA CTC | 38 | G protein- coupled receptor 113 (GPR113) | GPR113 | NM_153835 | 645 | NP_722577 | 902 |
| H24-038 | GCACGATT TGGAGGTC GCC | 39 | unc-51-like kinase 1 (*C. elegans*) | ULK1 | NM_003565 | 646 | NP_003556 | 903 |
| H24-039 | CGCTCTGG AGTCTCTC TCC | 40 | neurotrophic tyrosine kinase, receptor, type 1 | NTRK1 | NM_002529 | 647 | NP_002520 | 904 |
| H24-040 | CCCCAACT ACACGGAG TTC | 41 | glycogen synthase kinase 3 alpha | GSK3A | NM_019884 | 648 | NP_063937 | 905 |
| H24-041 | GGACTCTC AGTTCAGC ATC | 42 | phosphoinos- itide-3-kinase, class 2, beta polypeptide | PIK3C2B | NM_002646 | 376 | NP_002637 | 418 |
| H24-042 | CTTTGCGA TACATGAG CCC | 43 | protein kinase, interferon- inducible double stranded RNA dependent | PRKR | NM_002759 | 649 | NP_002750 | 906 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-043 | CTTCCTGA AGACCAGG TTC | 44 | FUSED serine/threonine kinase | STK36, Fused | AF200815 NM_015690 | 650 651 | AF200815's protein NP_056505 | 1125 907 |
| H24-044 | GAATGCTG GCAACAAG ACC | 45 | mixed lineage kinase 4alpha- mixed lineage kinase 4beta | HSA311797, HSA311798, MLK4, KIAA1804 | AJ311797 SK691 NM_032435 | 652 653 654 | AJ311797's protein SK691's protein NP_115811 | 1126 1127 908 |
| H24-045 | GAAGATGT CAACGCCC ATC | 46 | casein kinase 1, epsilon | CSNK1E, CK1e | NM_001894 NM_152221 | 655 656 | NP_001885 NP_689407 | 909 910 |
| H24-046 | TTCTACGC ACCAGAAC TCC | 47 | calcium- sensing receptor (hypocalciuric hypercalcemial, severe neonatal hyperparathy- roidism) | CASR | NM_000388 | 657 | NP_000379 | 911 |
| H24-047 | TGACGGTT GCATTTGC CAC | 48 | gonadotropin- releasing hormone receptor | GNRHR | NM_000406 | 658 | NP_000397 | 912 |
| H24-048 | CCAGACCT CGAGCAAC TCC | 49 | adrenergic, alpha-1B-, receptor | ADRA1B | NM_000679 | 659 | NP_000670 | 913 |
| H24-050 | GGAGTGCA ATCTGGTT TAC | 50 | dopamine receptor D1 | DRD1 | NM_000794 | 660 | NP_000785 | 914 |
| H24-051 | CAGTCAGT GCAACAGT GTC | 51 | dopamine receptor D3 | DRD3 | NM_000796 NM_033658 NM_033659- NM_033663 | 661 662 663 664 | NP_000787 NP_387507 NP_387508 NP_387512 | 915 916 917 918 |
| H24-052 | CGTGCTTG TCATGTTC GGC | 52 | opioid receptor, delta 1 | OPRD1 | NM_000911 | 665 | NP_000902 | 919 |
| H24-053 | TGACAGGT TCCGTCTG GGC | 53 | tachykinin receptor 1 | TACR1 | NM_001058 | 666 | NP_001049 | 920 |
| H24-054 | GTACCTGC GGCAGTTG TTC | 54 | chemokine (C—C motif) receptor 1 | CCR1 | NM_001295 | 342 | NP_001286 | 384 |
| H24-055 | GACCATCA CCATCCTG GCC | 55 | frizzled homolog 2 (Drosophila) | FZD2 | NM_001466 | 667 | NP_001457 | 921 |
| H24-056 | GCAGGCAG AGGACAGA TTC | 56 | bombesin-like receptor 3 | BRS3 | NM_001727 | 668 | NP_001718 | 922 |
| H24-057 | CAAAGCCA TGCCCGTA AGC | 57 | bombesin-like receptor 3 | BRS3 | NM_001727 | 669 | NP_001718 | 923 |
| H24-058 | AAGTGCCC TGGCCTTC TTC | 58 | formyl peptide receptor 1 | FPR1 | NM_002029 | 670 | NP_002020 | 924 |
| H24-059 | CTACCACA AGCAGGTG TCC | 59 | frizzled homolog 5 (Drosophila) | FZD5 | NM_003468 | 671 | NP_003459 | 925 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-060; H24-168 | TGCGTGCT TCTTTGTG GGC | 60 | smoothened homolog (Drosophila) | SMOH | NM_005631 | 672 | NP_005622 | 926 |
| H24-061 | CTACGTCA TCCTGTGC CTC | 61 | melanocortin 5 receptor | MC5R | NM_005913 | 673 | NP_005904 | 927 |
| H24-062; H24-166 | TTCGGACA CCCACAAA TGC | 62 | retinal pigment epithelium-derived rhodopsin homolog | RRH | NM_006583 | 674 | NP_006574 | 928 |
| H24-064; H24-164 | GTTGTCCT GTTCTGAC GTC | 63 | olfactory receptor, family 1, subfamily A, member 2 | OR1A2 | NM_012352 | 364 | NP_036484 | 406 |
| H24-065 | GCAGGCTT TCGAGTAT GGC | 64 | paired basic amino acid cleaving system 4 | PACE4 | NM_002570 NM_138319 NM_138320 NM_138321 NM_138322 NM_138323 NM_138324 NM_138325 | 675 676 677 678 679 680 681 682 | NP_002561 NP_612192 NP_612193 NP_612194 NP_612195 NP_612196 NP_612197 NP_612198 | 929 930 931 932 933 934 935 936 |
| H24-066 | CCTCTCTG TCAACACA TGC | 65 | leucine-rich repeat-containing G protein-coupled receptor 7 | LGR7 | NM_021634 | 683 | NP_067647 | 937 |
| H24-067 | ATGACGCT ACGCAAGA ACC | 66 | beta-amyloid binding protein precursor | BBP | NM_032027 | 684 | NP_114416 | 938 |
| H24-068 | AGCGGGTG CTTACATT GCC | 67 | proteasome (prosome, macropain) subunit, beta type, 5 | PSMB5 | NM_002797 | 685 | NP_002788 | 939 |
| H24-069 | GCAAGAAT GCACAGAG AGC | 68 | retinoic acid receptor, beta | RARB | NM_000965 NM_016152 | 686 687 | NP_000956 NP_057236 | 940 941 |
| H24-070 | TTTGTGCT GACAGCTG CTC | 69 | similar to granzyme B (granzyme 2, cytotoxic T-lymphocyte-associated serine esterase 1) (H. sapiens) | CTLA1 | NM_033423 | 688 | NP_219491 | 942 |
| H24-071 | CACCTGCT TTCTCAAT GCC | 70 | KIAA1453 protein | KIAA1453 | NM_025090 | 689 | NP_079366 | 943 |
| H24-072 | GGTTCTCT GACTCGAA CAC | 71 | fetuin B | FETUB | NM_014375 | 690 | NP_055190 | 944 |
| H24-073 | AGCACCTC GCTGACAT TCC | 72 | sentrin/SUMO-specific protease 3 | SENP3 | NM_015670 | 691 | NP_056485 | 945 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-074 | CCTGGGCA ACACCTGC TAC | 73 | DKFZP586D2 223 protein | DKFZP586 D2223 | NM_018561 | 692 | NP_061031 | 946 |
| H24-075 | CTTAAGGT GGACCTGT GGC | 74 | carboxypeptidase A6 | CPA6 | NM_020361 | 693 | NP_065094 | 947 |
| H24-076 | TTGCACAG AAAGGAGG TGC | 75 | putative intramembrane cleaving protease | SPPL2A | NM_032802 | 694 | NP_116191 | 948 |
| H24-077 | GCCCGCAG TCTTACAC AAC | 76 | similar to protease | LOC121302 | XM_062575 | 695 | XP_062575 | 949 |
| H24-078 | GCTTCTGG TGGAGAAG GAC | 77 | transglutam- inase 6 | TGM6 | NM_198994 | 696 | NP_945345 | 950 |
| H24-079 | GTGTATGA AGTGGTCC ACC | 78 | liver-specific organic anion transporter 3 | LST-3 | NM_001009562 | 1120 | NP_001009562 | 951 |
| H24-080 | GAAATCTC ACTGCTTC GAC | 79 | similar to caspase 1, isoform alpha precursor; interleukin 1-beta convertase; interleukin 1-B converting enzyme; IL1B-convertase | LOC160131 | XM_090078 | 697 | XP_090078 | 952 |
| H24-081 | CACTTTAT AAGCCTGC GGC | 80 | similar to bA395L14.5 (novel phosphogluco- mutase like protein) | LOC284964 | XM_209423 | 698 | XP_209423 | 953 |
| H24-082 | TGGGCATC CTGGCTGT AAC | 81 | LOC254378 | LOC254378 | XM_174812 | 699 | XP_174812 | 954 |
| H24-083 | ATAGACTG CAGAATGA GCC | 82 | complement component 9 | C9 | NM_001737 | 700 | NP_001728 | 955 |
| H24-084 | CAGTGCCA AGAAGGAG CCC | 83 | neuron navigator 2 | NAV2 | NM_018162 NM_145117 | 701 702 | NP_060632 NP_660093 | 956 957 |
| H24-085 | TGTGCTCG AAGGAGGA ATC | 84 | highly charged protein D13S106E | D13S106E | NM_005800 | 703 | NP_005791 | 958 |
| H24-086 | ATGTATGG ATTCCAGC ACC | 85 | butyrylcho- linesterase | BCHE | NM_000055 | 704 | NP_000046 | 959 |
| H24-087 | GCTCTGCT ATGTGTCA GTC | 86 | Hin-1 | HSHIN1 | NM_017493 NM_199324 | 705 706 | NP_059963 NP_955356 | 960 961 |
| H24-088 | TGTGACTA AGCTGGAA GAC | 87 | polycystic kidney disease (polycystin) and REJ | PKDREJ | NM_006071 | 707 | NP_006062 | 962 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| | | | (sperm receptor for egg jelly homolog, sea urchin)-like | | | | | |
| H24-089 | TGCGCACAATACTGGCCAC | 88 | protein tyrosine phosphatase, non-receptor type 1 | PTPN1 | NM_002827 | 708 | NP_002818 | 963 |
| H24-090 | TTCCCGCTACCAGACCTAC | 89 | glutamate receptor, ionotropic, kainate 4 | GRIK4 | NM_014619 | 709 | NP_055434 | 964 |
| H24-091 | AGCATGGTCATTCACATCC | 90 | potassium channel, subfamily K, member 9 | KCNK9 | NM_016601 | 710 | NP_057685 | 965 |
| H24-092 | ATGCAGGTCCATATGTGAC | 91 | transient receptor potential cation channel, subfamily M, member 6 | TRPM6 | NM_017662 | 711 | NP_060132 | 966 |
| H24-093 | CCTTTCTCTGAACACGGAC | 92 | ataxia telangiectasia and Rad3 related | ATR | NM_001184 | 712 | NP_001175 | 967 |
| H24-094 | GTCAGGCTGAATGAGGAGC | 93 | p21(CDKN1A)-activated kinase 6 | PAK6 SK429 | NM_020168 | 374 375 | NP_064553 SK429's protein | 416 417 |
| H24-095 | CAGGTTCTCCTCAAACGGC | 94 | taste receptor, type 1, member 3 | TAS1R3 | XM_371210 | 713 | XP_371210 | 968 |
| H24-096 | GCATAGGAGTGGTCATATC | 95 | similar to tensin | LOC223021 | XM_167349 | 714 | XP_167349 | 969 |
| H24-097 | ACATCCTGCTGTCAGAGCC | 96 | thousand and one amino acid protein kinase-prostate derived STE20-like kinase PSK | TAO1, PSK | NM_016151 NM_004783 | 351 352 | NP_057235 NP_004774 | 393 394 |
| H24-098 | CATGGAGTTCAGCAAGATC | 97 | solute carrier family 10 (sodium/bile acid cotransporter family), member 1 | SLC10A1 | NM_003049 | 715 | NP_003040 | 970 |
| H24-099 | GTTCTCCAGTGCCATTGGC | 98 | solute carrier family 16 (monocarboxylic acid transporters), member 3 | SLC16A3 | NM_004207 | 366 | NP_004198 | 408 |
| H24-100 | TTCGGCCTGGACGTCTATC | 99 | organic cationic transporter-like 3 | ORCTL3 | NM_004256 | 716 | NP_004247 | 971 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-101 | GTGCATTGGTGAAAGAGAC | 100 | interleukin 5 (colony-stimulating factor, eosinophil) | IL5 | NM_000879 | 717 | NP_000870 | 972 |
| H24-102 | TGTGCAGGATAATTGCTGC | 101 | transforming growth factor, beta 2 | TGFB2 | NM_003238 | 718 | NP_003229 | 973 |
| H24-103 | AGGTGTCACTGTACAGTCC | 102 | tumor necrosis factor receptor superfamily, member 10a | TNFRSF10A | NM_003844 | 719 | NP_003835 | 974 |
| H24-104 | AGTGCGCATCTTCGGCCTC | 103 | fibroblast growth factor 14 | FGF14 | NM_004115 | 720 | NP_004106 | 975 |
| H24-105 | TTTGTGGACTCCTACGATC | 104 | Ras homolog enriched in brain 2 | RHEB2 | NM_005614 | 721 | NP_005605 | 976 |
| H24-106 | GCCCTGATGTCCATCTTCC | 105 | NADPH-dependent FMN and FAD containing oxidoreductase | NR1 | NM_014434 | 722 | NP_055249 | 977 |
| H24-107 | CATAGGGAAGGACACTTGC | 106 | interleukin 1 family, member 8 (eta) | IL1F8 | NM_014438 | 723 | NP_055253 | 978 |
| H24-108 | CCTGGATGTGAGAGAGAGC | 107 | interleukin 1 family, member 8 (eta) | IL1F8 | NM_014438 | 724 | NP_055253 | 979 |
| H24-109 | AACTTGTACTATGAAGGCC | 108 | Ras association (RalGDS/AF-6) domain family 2 | RASSF2 | NM_014737 NM_170774 | 725 726 | NP_055552 NP_739580 | 980 981 |
| H24-110 | GTATTCTGTACACCCTGGC | 109 | androgen-regulated short-chain dehydrogenase/reductase 1 | ARSDR1 | NM_016026 | 727 | NP_057110 | 982 |
| H24-111 | TTCTCGCAATGGCCAATGC | 110 | peptidylpro-lylisomerase (cyclophilin)-like 1 | PPIL1 | NM_016059 | 728 | NP_057143 | 983 |
| H24-112 | GAAGAACAGCAGCCTGGAC | 111 | RAS, dexamethasone-induced 1 | RASD1 | NM_016084 | 365 | NP_057168 | 407 |
| H24-113 | TCAGGCGGATCTTGACAGC | 112 | dicarbonyl/L-xylulose reductase | DCXR | NM_016286 | 729 | NP_057370 | 984 |
| H24-114 | TTCGGCACTGGTTTCCCTC | 113 | casein kinase 2, beta polypeptide | CSNK2B | NM_001320 | 730 | NP_001311 | 985 |
| H24-115 | GACGAATATCAGCTCTGCC | 114 | protein kinase, AMP-activated, gamma 2 non-catalytic subunit | PRKAG2 | NM_016203 | 731 | NP_057287 | 986 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-116 | CCTCTCTACGCCATCTACC | 115 | ATP-binding cassette, sub-family G (WHITE), member 8 (sterolin 2) | ABCG8 | NM_022437 | 732 | NP_071882 | 987 |
| H24-117 | TCTCTCCACACAAACCTTC | 116 | chromosome 20 open reading frame 121 | C20orf121 | NM_024331 | 733 | NP_077307 | 988 |
| H24-118 | GGTCGGGAGGAGAACAGTC | 117 | organic cation transporter OKB1 | OKB1 | NM_033125 | 734 | NP_149116 | 989 |
| H24-119 | GCGAATTCCACCAGCATTC | 118 | solute carrier family 26, member 8 | SLC26A8 | NM_052961 | 735 | NP_443193 | 990 |
| H24-120 | TGTCCAGGACCTATTGAGC | 119 | UDP glycosyltransferase 1 family, polypeptide A1 | UGT1A1 | NM_000463 | 736 | NP_000454 | 991 |
| H24-121 | TGACCATCTGCATGATGTC | 120 | 3-hydroxy-3-methylglutaryl-Coenzyme A reductase | HMGCR | NM_000859 | 737 | NP_000850 | 992 |
| H24-122 | GCATGGCATAGTTGGATTC | 121 | hydroxyprostaglandin dehydrogenase 15-(NAD) | HPGD | NM_000860 | 738 | NP_000851 | 993 |
| H24-123 | ATGCAGGACATGAACAACC | 122 | phospholipase C, gamma 2 (phosphatidyl-inositol-specific) | PLCG2 | NM_002661 | 739 | NP_002652 | 994 |
| H24-124 | ATGTGTGAATGTGGGTTGC | 123 | thioredoxin reductase 1 | TXNRD1 | NM_182729 NM_003330 NM_182742 NM_182743 | 740 741 742 743 | NP_877393 NP_003321 NP_877419 NP_877420 | 995 996 997 998 |
| H24-125 | TGCAGGCTATTCTGTGAGC | 124 | UDP-Gal:betaGlcNAc beta 1,4-galactosyltransferase, polypeptide 5 | B4GALT5 | NM_004776 | 744 | NP_004767 | 999 |
| H24-126 | TCGGCACAACAATCTAGAC | 125 | isocitrate dehydrogenase 3 (NAD+) beta | IDH3B | NM_174855 NM_006899 NM_174856 | 745 746 747 | NP_777280 NP_008830 NP_777281 | 1000 1001 1002 |
| H24-127 | GACAGGTGGACAGAGCATC | 126 | sialyltransferase 4B (beta-galactosidase alpha-2,3-sialytransferase) | SIAT4B | NM_006927 | 748 | NP_008858 | 1003 |
| H24-128 | TGTGCGAGACCTCGATTTC | 127 | HMT1 hnRNP methyltransferase-like 3 (S. cervisiae) | HRMT1L3 | NM_019854 | 343 | NP_062828 | 385 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-129 | AGTTTGTG TAGGTATC GCC | 128 | UDP-Gal:betaGlcNAc beta 1,3-galactosyltransferase, polypeptide 1 | B3GALT1 | NM_020981 | 749 | NP_066191 | 1004 |
| H24-130 | AGCATGAA AGAAACCC TGC | 129 | 0-peroxisomal short-chain alcohol dehydrogenase | ENSG00000169, DHRS4, DHRS4L2 | ENSG000001690 66, NM_021004, NM_198083 | 750 751 752 | ENSG000001690 66's protein NP_066284 NP_932349 | 1128 1005 1006 |
| H24-131 | GAAGATCA CCATTGCT GAC | 130 | similar to peptidylprolylisomerase A (cyclophilin A)- similar to Peptidyl-prolyl cis-trans isomerase A (PPIase) (Rotamase) (Cyclophilin A) (Cyclosporin A-binding protein) (SP18) | PPIA, LOC341457 LOC126170, LOC388817, LOC402102, LOC440892, LOC439953, LOC343384, OAS2, LOC390299, LOC388687, LOC388686, LOC128192, LOC392352 | XM_292085 XM_497621 XM_371409 NM_203431 XM_497870 XM_496579 XM_495800 NM_203430 XM_291544 NM_178230 XM_372452 XM_371304 XM_371302 XM_060887 XM_373301 NM_021130 | 753 1121 754 755 756 757 758 759 760 761 762 763 1122 764 765 766 767 | XP_292085 XP_497621 XP_371409 NP_982255 XP_497870 XP_496579 XP_495800 NP_982254 XP_291544 NP_839944 XP_372452 XP_371304 XP_371302 XP_060887 XP_373301 NP_066953 | 1007 1008 1009 1010 1011 1012 1013 1015 1016 1017 1018 1020 1021 1022 1023 1024 |
| H24-132 | GCATGAAT ATTGTGGA GGC | 131 | similar to peptidylprolylisomerase A (cyclophilin A)- similar to Peptidyl-prolyl cis-trans isomerase A (PPIase) (Rotamase) (Cyclophilin A) (Cyclosporin A-binding protein) (SP18) | PPIA, LOC126170, LOC388817, LOC402102, LOC391062, PPIA, LOC390299, LOC391352, LOC128192 | XM_497621 XM_371409 NM_203431 XM_497870 XM_372785 NM_203430 XM_372452 XM_372916 XM_060887 NM_021130 | 1121 768 769 770 771 772 773 774 775 776 | XP_497621 XP_371409 NP_982255 XP_497870 XP_372785 NP_982254- XP_372452 XP_372916 XP_060887 NP_066953 | 1025 1026 1027 1028 1029 1030 1031 1032 1033 1034 |
| H24-133 | TGCAGGCA AGCAGACG GTC | 132 | 3-oxoacid CoA transferase 2 | OXCT2 | NM_022120 | 777 | NP_071403 | 1035 |
| H24-134 | TGACGCAG ATGATGAA TCC | 133 | gycosyltransferase | LOC83468 | NM_031302 | 778 | NP_112592 | 1036 |
| H24-135 | TGGCGCCA TGTCAGAG TGC | 134 | histone deacetylase 10 | HDAC10 | NM_032019 | 779 | NP_114408 | 1037 |
| H24-136 | CTTATTGT TCACATTG GCC | 135 | similar to cytochrome P-450 | LOC170327 | XM_093255 | 780 | XP_093255 | 1038 |
| H24-137 | TGGCACCT ATGAGAGG ATC | 136 | similar to UDP-glucuronosyl-transferase | LOC166624 | XM_093980 | 781 | XP_093980 | 1039 |
| H24-138 | TCAGGTGT CCCATTCC AGC | 137 | interleukin-1 receptor-associated kinase 2 | IRAK2 | NM_001570 SK180 | 344 345 | NP_001561 SK180's protein | 386 387 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-139 | CTCAGAGG TGGTGGAA GAC | 138 | IL2-inducible T-cell kinase | ITK | NM_005546 | 782 | NP_005537 | 1040 |
| H24-140 | TGCAGGAG GAAATTGA TGC | 139 | cytochrome P450, subfamily IIIA (niphedipine oxidase), polypeptide 3-cytochrome P450, subfamily IIIA (niphedipine oxidase), polypeptide 4 | AF182273, CYP3A3, CYP3A4 | AF182273 NM_000776 NM_017460 | 783 784 785 | AF182273's protein NP_000767 NP_059488 | 1129 1041 1042 |
| H24-141 | GAGTCCAG CCTTCATG CCC | 140 | cytochrome P450, subfamily IIF, polypeptide 1 | HUMCYPIIF, CYP2F1 | J02906 NM_000774 | 786 787 | J02906's protein NP_000765 | 1130 1043 |
| H24-142 | GTCCAGCT GAAGAAGA TCC | 141 | glutamate receptor, ionotropic, N-methyl D-aspartate 2A | GRIN2A | NM_000833 | 339 | NP_000824 | 381 |
| H24-143 | TTCGGCAC TGAGGTCT TGC | 142 | hypothetical protein FLJ22955 | FLJ22955 | NM_024819 | 359 | NP_079095 | 401 |
| H24-144 | TTGCACAC TGAGCTGG AGC | 143 | hypothetical protein FLJ22955 | FLJ22955 | NM_024819 | 866 | NP_079095 | 1044 |
| H24-145 | CCTGCTCT TGAGCAAT AAC | 144 | tumor endothelial marker 5 precursor | TEM5 | NM_032777 | 788 | NP_116166 | 1045 |
| H24-146 | TGTCCAGA CCACATGG AGC | 145 | similar to cytochrome P450, subfamily IVF, polypeptide 2; leukotriene B4 omega-hydroxylase; leukotriene-B4 20-monooxy-genase | LOC126537 | XM_497611 | 789 | XP_497611 | 1046 |
| H24-147 | TTGCAGGA GGACAAGA TGC | 146 | G protein-coupled receptor 153 | GPR153 | NM_207370 | 790 | NP_997253 | 1047 |
| H24-148 | GATTGTGG CCAAGAAG TAC | 147 | chloride intracellular channel 6 | CLIC6 | XM_092804 NM_053277 | 335 336 | XP_092804 NP_444507 | 377 378 |
| H24-149 | CCTCATTA TCACCATG CTC | 148 | G protein-coupled receptor 150 | GPR150 | XM_094471 NM_199243 | 360 361 | XP_094471 NP_954713 | 402 403 |
| H24-150 | CTGGTTAT TGGCGGGT ATC | 149 | FLJ16008 protein | FLJ16008 | NM_001001665 | 791 | NP_001001665 | 1048 |
| H24-151 | TTTGTGCT TCACCAAG TGC | 150 | G protein-coupled receptor 97 | GPR97 | NM_170776 | 792 | NP_740746 | 1049 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-152 | CTGCACAGTCAACACGGTC | 151 | similar to N-formyl peptide receptor | LOC256135 | XM_172523 | 793 | XP_172523 | 1050 |
| H24-153 | GCAGAGCCAAATATCAGCC | 152 | LOC254502 | LOC254502 | XM_174355 | 794 | XP_174355 | 1051 |
| H24-154 | GTTCAAGAAGCTGCGCCAC | 153 | opsin 1 (cone pigments), medium-wave-sensitive (color blindness, deutan) - opsin 1 (cone pigments), long-wave-sensitive (color blindness, protan) | OPN1MW, OPN1LW | NM_000513 NM_020061 | 795 796 | NP_000504 NP_064445 | 1052 1053 |
| H24-155 | CGTCTTCATCAGCGTGCAC | 154 | G protein-coupled receptor 30 | GPR30 | NM_001505 | 797 | NP_001496 | 1054 |
| H24-156 | GCAGTTCCAAGCTTGCATC | 155 | opsin 1 (cone pigments), short-wave-sensitive (color blindness, tritan) | OPN1SW | NM_001708 | 798 | NP_001699 | 1055 |
| H24-157 | GTACCTGCGCCACTTCTTC | 156 | chemokine (C—C motif) receptor 3 | CCR3 | NM_178329 NM_001837 | 354 355 | NP_847899 NP_001828 | 396 397 |
| H24-158 | GACCATCACTATCCTGGCC | 157 | frizzled homolog 7 (Drosophila) | FZD7 | NM_003507 | 799 | NP_003498 | 1056 |
| H24-159 | GTCCTTCTACATCAATGCC | 158 | G protein-coupled receptor 23 | GPR23 | NM_005296 | 337 | NP_005287 | 379 |
| H24-160 | GAAGAAGCAACTGGGAGCC | 159 | G protein-coupled receptor 64 | GPR64 | NM_005756 | 338 | NP_005747 | 380 |
| H24-162 | GTTCCAGACCTTCATGTGC | 160 | chemokine (C—C motif) receptor 9 | CCR9 | NM_006641 NM_031200 | 800 801 | NP_006632 NP_112477 | 1057 1058 |
| H24-163; H24-226 | CTGGACCGAGCTGCTTGAC | 161 | adrenomedullin receptor | ADMR | NM_007264 | 802 | NP_009195 | 1059 |
| H24-165 | GCAGAGCATGGGCTTAAGC | 162 | G protein-coupled receptor | G2A | NM_013345 | 803 | NP_037477 | 1060 |
| H24-167; H24-228 | AGCAGGCGGAACATGTTCC | 163 | calcium channel, voltage-dependent, beta 3 subunit | CACNB3 | NM_000725 | 804 | NP_000716 | 1061 |
| H24-169 | CAACCTGTTCATCCTTAAC | 164 | galanin receptor 2 | GALR2 | NM_003857 | 371 | NP_003848 | 413 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-170 | ATTTGGTGACACGGCTGAC | 165 | chromosome 10 open reading frame 112 | C10orf112 | XM_295865 | 805 | XP_295865 | 1062 |
| H24-171 | CATATGGCTCTTCAAGTAC | 166 | similar to solute carrier family 9 (sodium/hydrogen exchanger), isoform 7; nonselective sodium potassium/proton exchanger | LOC121456 | XM_062645 | 806 | XP_062645 | 1063 |
| H24-172 | TGGCACAGTAACAGCTGCC | 167 | acetyl-Coenzyme A acetyltransferase 1 (acetoacetyl Coenzyme A thiolase) | ACAT1 | NM_000019 | 807 | NP_000010 | 1064 |
| H24-173 | GTTCTCTCAGCACGTTCGC | 168 | placental growth factor, vascular endothelial growth factor-related protein | PGF | NM_002632 | 808 | NP_002623 | 1065 |
| H24-174 | TGCAGACTTCAGTGCAGCC | 169 | Rhesus blood group-associated glycoprotein | RHAG | NM_000324 | 809 | NP_000315 | 1066 |
| H24-175 | CTTTCTGGAAATCCTGCCC | 170 | solute carrier family 39 (zinc transporter), member 3 | SLC39A1 | NM_014437 | 810 | NP_055252 | 1067 |
| H24-176 | CAACACAGCAGACACAGTC | 171 | UDP-N-acetyl-alpha-D-galactosamine: N-acetylneuraminyl)-galactosylglucosyl-ceramide N-acetylgalactosaminyltransferase (GalNAc-T) | GALGT | NM_001478 | 811 | NP_001469 | 1068 |
| H24-177 | TGGGACCAGTGACTGCAGC | 172 | glycosylphosphatidylinositol specific phospholipase D1 | GPLD1 | NM_001503 | 812 | NP_001494 | 1069 |
| H24-178 | AGCCAGAGGAGTTTGTGGC | 173 | HMT1 hnRNP methyltransferase-like 1 (S. cerevisiae) | HRMT1L1 | NM_001535 NM_206962 | 813 814 | NP_001526 NP_996845 | 1070 1071 |
| H24-179 | CTCGCAGGAAATTCTGGAC | 174 | GS3955 protein | GS3955 | NM_021643 | 815 | NP_067675 | 1072 |

TABLE 1-continued

| TARGET Id | KD TARGET Sequence (5'→3') | SEQ ID NO. | TARGET Gene Name | TARGET Gene Symbol | Genbank DNA/RNA Accession | DNA/ RNA SEQ ID NO. | Genbank Polypeptide Accession | PP SEQ ID NO. |
|---|---|---|---|---|---|---|---|---|
| H24-180 | ATGCAGGT CAGGTTGT TTC | 175 | solute carrier family 4, sodium bicarbonate transporter-like, member 10 | SLC4A10 | NM_022058 | 816 | NP_071341 | 1073 |
| H24-181 | ATCAGGCC TTACATCC AGC | 176 | phosphoprotein regulated by mitogenic pathways | C8FW | NM_025195 | 817 | NP_079471 | 1074 |
| H24-182 | CTGTGGGA GAAACAGA GAC | 177 | similar to hypothetical protein, MNCb-4779 | LOC165927 | XM_093541 | 818 | XP_093541 | 1075 |
| H24-183 | CTCTGCGA CTACTACC TGC | 178 | UDP-Gal:betaGal beta 1,3-galactosyltrans-ferase polypeptide 6 | B3GALT6 | NM_080605 | 819 | NP_542172 | 1076 |
| H24-184 | CTGATGAA GGCCTTCG ACC | 179 | similar to NADH-ubiquinone oxidoreductase PDSW subunit (Complex I-PDSW) (CI-PDSW) | LOC123326 | XM_063593 | 820 | XP_063593 | 1077 |
| H24-185 | ACCGTGGA GGCCTAT CGC | 180 | cytochrome P450, subfamily XXIV (vitamin D 24-hydroxylase) | CYP24 | NM_000782 | 370 | NP_000773 | 412 |
| H24-186 | TTCCAGCT GATATATC CAC | 181 | hypothetical protein FLJ11149 | FLJ11149 | NM_018339 | 821 | NP_060809 | 1078 |
| H24-187 | GCCAGACA CTGACAAG TTC | 182 | | TTBK2 | SK453 NM_173500 | 822 823 | SK453's protein NP_775771 | 1131 1079 |
| H24-188 | TCGGCAGG GCCAGCAT TTC | 183 | macrophage stimulating 1 (hepatocyte growth factor-like) | MST1 | NM_020998 | 824 | NP_066278 | 1080 |
| H24-189 | GTCTTCGA CCCTCAGG AAC | 184 | histidine-rich glycoprotein | HRG | NM_000412 | 825 | NP_000403 | 1081 |
| H24-190 | TCAGAAGG TTGTGCAG GAC | 185 | KIAA0943 protein | APG4B | NM_013325 NM_178326 | 826 827 | NP_037457 NP_847896 | 1082 1083 |
| H24-191 | CAACTTGC ATGACTAC GGC | 186 | amyloid beta (A4) precursor protein (protease nexin-II, Alzheimer disease) | APP | NM_201414 NM_000484 NM_201413 | 828 829 830 | NP_958817 NP_000475 NP_958816 | 1084 1085 1086 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-192 | TGTGCAAG AGGTTCGT TGC | 187 | protein phosphatase 2 (formerly 2A), catalytic subunit, beta isoform | PPP2CB | NM_004156 | 831 | NP_004147 | 1087 |
| H24-193 | ACCAGTGG TAAATGTC AGC | 188 | dual specificity phosphatase 5 | DUSP5 | NM_004419 | 358 | NP_004410 | 400 |
| H24-194 | CTCTGTAT CCCATTCC CTC | 189 | mitogen-activated protein kinase kinase kinase 9 | MAP3K9 | NM_033141 XM_027237 | 346 347 | NP_149132 XP_027237 | 388 389 |
| H24-195 | CTTCTTGA AGCATCTA TGC | 190 | mitogen-activated protein kinase kinase kinase 1 | MAP3K1 | XM_042066 | 832 | XP_042066 | 1088 |
| H24-196 | CATGCTGT TGTCCTTT ACC | 191 | leucyl/cystinyl aminopeptidase | LNPEP | NM_005575 | 833 | NP_005566 | 1089 |
| H24-197 | CGAAGATG TTGACCTG GTC | 192 | ribonuclease L (2',5'-oligoisoadenyl-ate synthetase-dependent) | RNASEL | NM_021133 | 834 | NP_066956 | 1090 |
| H24-198 | TGTCCTGT TGGATGCA CAC | 193 | protein kinase, AMP-activated, alpha 2 catalytic subunit | PRKAA2 | NM_006252 | 835 | NP_006243 | 1091 |
| H24-199 | ATGCAGAC CCTGGACC AAC | 194 | tumor necrosis factor receptor superfamily, member 11a, activator of NFKB | TNFRSF11A | NM_003839 | 836 | NP_003830 | 1092 |
| H24-200 | GTAGCACT CTGCGACA TGC | 195 | solute carrier family 39 (zinc transporter), member 4 | SLC39A4 | NM_017767 NM_130849 | 837 838 | NP_060237 NP_570901 | 1093 1094 |
| H24-201 | CTGGAATG GGATCCGA CAC | 196 | succinate dehydrogenase complex, subunit C, integral membrane protein, 15kD | SDHC | NM_003001 | 839 | NP_002992 | 1095 |
| H24-202 | GTTATTCT TCCACCAT GGC | 197 | nicotinamide N-methyl-transferase | NNMT | NM_006169 | 840 | NP_006160 | 1096 |
| H24-203 | TGCCAGCA GTCTCTTG ATC | 198 | ciliary neurotrophic factor receptor | CNTFR | NM_001842 | 841 | NP_001833 | 1097 |
| H24-204 | GATCTTCC GGCCCAAA CAC | 199 | insulin-like growth factor binding protein 5 | IGFBP5 | NM_000599 | 842 | NP_000590 | 1098 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| H24-205 | AGCATGACAGGAAACCTGC | 200 | UDP-glucose ceramide glucosyltransferase-like 2 | UGCGL2 | NM_020121 | 843 | NP_064506 | 1099 |
| H24-206 | TCTTCTCTGTGAACATACC | 201 | similar to NADH dehydrogenase subunit 1 | LOC136234 | XM_069782 | 844 | XP_069782 | 1100 |
| H24-207 | CCTTGTTGGCCAATGATTC | 202 | similar to Arylacetamide deacetylase | AADAC | NM_207365 | 845 | NP_997248 | 1101 |
| H24-208 | CCAGGTTTGTCAACGTGAC | 203 | azurocidin 1 (cationic antimicrobial protein 37) | AZU1 | NM_001700 | 846 | NP_001691 | 1102 |
| H24-209 | TTCCAGCTCAGTGCTAATC | 204 | similar to microtubule-associated proteins 1A/1B light chain 3 | LOC161785 | XM_091124 | 847 | XP_091124 | 1103 |
| H24-210 | AGCAGGAACATCTCTTCGC | 205 | similar to MNK1 | LOC219756 | XM_166676 | 848 | XP_166676 | 1104 |
| H24-211 | CAAGTTCTCCTGCAAGTTC | 206 | ATPase, H+/K+ exchanging, beta polypeptide | ATP4B | NM_000705 | 849 | NP_000696 | 1105 |
| H24-212 | GAGCATGACCTTCGATGGC | 207 | gamma-aminobutyric acid (GABA) receptor, rho 2 | GABRR2 | NM_002043 | 850 | NP_002034 | 1106 |
| H24-213 | CTGGCAGAAGCAGCACAAC | 208 | a disintegrin-like and metalloprotease (reprolysin type) with thrombospondin type 1 motif, 1 | ADAMTS1 | NM_006988 | 851 | NP_008919 | 1107 |
| H24-214 | TACCTGCTGGGCATCAAGC | 209 | fibroblast growth factor 4 (heparin secretory transforming protein 1, Kaposi sarcoma oncogene) | FGF4 | NM_002007 | 852 | NP_001998 | 1108 |
| H24-215 | CTGGAAGTCCTGTGTGATC | 210 | interferon, alpha 8 | IFNA8 | NM_002170 | 853 | NP_002161 | 1109 |
| H24-216 | GGACACCTTCCCAAATGTC | 211 | interleukin 19 | IL19 | NM_013371 NM_153758 | 854 855 | NP_037503 NP_715639 | 1110 1111 |
| H24-217 | GGCAGAAATTCCAGAGAGC | 212 | solute carrier family 10 (sodium/bile | SLC10A2 | NM_000452 | 856 | NP_000443 | 1112 |

TABLE 1-continued

| TARGET Id | KD TARGET Sequence (5'→3') | SEQ ID NO. | TARGET Gene Name | TARGET Gene Symbol | Genbank DNA/RNA Accession | DNA/RNA SEQ ID NO. | Genbank Polypeptide Accession | PP SEQ ID NO. |
|---|---|---|---|---|---|---|---|---|
| | | | acid cotransporter family), member 2 | | | | | |
| H24-218 | CAACATCCCAACTGTGGTC | 213 | glutathione reductase | GSR | NM_000637 | 857 | NP_000628 | 1113 |
| H24-219 | TATCCTGACCTTCCTGCGC | 214 | potassium voltage-gated channel, subfamily G, member 1 | KCNG1 | NM_002237 NM_172318 | 372 373 | NP_002228 NP_758529 | 414 415 |
| H24-220 | TGTTTACCAGTCCGAAGCC | 215 | fibroblast growth factor 21 | FGF21 | NM_019113 | 858 | NP_061986 | 1114 |
| H24-221 | AACTGTACCGCAGAGTTCC | 216 | similar to INOSINE-5-MONOPHOSPHATE DEHYDROGENASE 1 (IMP DEHYDRO-GENASE 1) (IMPDH-I) (IMPD 1) | LOC131961 | XM_067688 | 859 | XP_067688 | 1115 |
| H24-222 | AGCATGATGATAGTTCCTC | 217 | topoisomerase (DNA) II beta (180kD) | TOP2B | NM_001068 | 860 | NP_001059 | 1116 |
| H24-223 | CAAGTGCCGTATCATCCAC | 218 | SFRS protein kinase 1 | SRPK1 SK358 | NM_003137 | 861 862 | NP_003128 SK358's protein | 1117 1132 |
| H24-224 | TATTCGTGCGGAGGAAGAC | 219 | chromosome 9 open reading frame 96 | SgK071, C9orf96 | SK521 NM_153710 | 863 864 | SK521's protein NP_714921 | 1133 1118 |
| H24-227 | GTACCTGCTGGTGGAGTTC | 220 | procollagen-proline, 2-oxoglutarate 4-dioxygenase (proline 4-hydroxylase), beta polypeptide (protein disulfide isomerase; thyroid hormone binding protein p55) | P4HB | NM_000918 | 865 | NP_000909 | 1119 |

TABLE 1A

| KD TARGET Sequence (5'→3') | SEQ ID NO. | TARGET Gene Name | TARGET Gene Symbol | Genbank DNA/RNA Accession |
|---|---|---|---|---|
| CGTTGGCAGAATCATTTAC | 247 | G protein-coupled receptor 38 | GPR38 | NM_001507 |
| TTCGCGGATGATGTACTTC | 248 | G protein-coupled receptor 38 | GPR38 | NM_001507 |
| CTCTCAGTACTTTAACATC | 249 | G protein-coupled receptor 38 | GPR38 | NM_001507 |
| CATAACAAAGGCATCGCCC | 250 | MAP kinase-interacting serine/threonine kinase 2 | MKNK2, MNK2 | NM_199054 NM_017572 SK236 |

TABLE 1A-continued

| KD TARGET Sequence (5'→3') | SEQ ID NO. | TARGET Gene Name | TARGET Gene Symbol | Genbank DNA/RNA Accession |
|---|---|---|---|---|
| TTAATGATAGCCATCCAGC | 251 | casein kinase 1, gamma 1 | CSNK1G1, CK1g1 | NM_022048 SK647 |
| ATTCCAGGCCATTTATGGC | 252 | granzyme K (serine protease, granzyme 3; tryptase II) | GZMK | NM_002104 |
| TGTTAGACTACGTGATGAC | 253 | hypothetical protein FLJ14906 | FLJ14906 | NM_032859 |
| CAACCTCACCTACAGGATC | 254 | matrix metalloproteinase 23A - matrix metalloproteinase 23B | MMP23A, MMP23B | NM_006983 NM_004659 |
| TCTACCCGATCAACCACAC | 255 | matrix metalloproteinase 23A - matrix metalloproteinase 23B | MMP23A, MMP23B | NM_006983 NM_004659 |
| CCCTTGGAGGAACTATGCC | 256 | LOC254378 | LOC254378 | XM_174812 |
| CAACTCAGACAACTGCATC | 257 | LOC254378 | LOC254378 | XM_174812 |
| TCATTGTAAGGCTGTGGCC | 258 | similar to bile salt-dependent lipase oncofetal isoform | LOC138529 | XM_070951 |
| GGACCAATGGGAGATAGAC | 259 | fyn-related kinase | FRK | NM_002031 |
| AGCTTATCCAGCTTTATGC | 260 | fyn-related kinase | FRK | NM_002031 |
| GTGCATTAACAAGAAGAAC | 261 | unc-51-like kinase 1 (C. elegans) | ULK1 | NM_003565 |
| ACCTGCAGCCTTCACTTTC | 262 | chemokine (C-C motif) receptor 1 | CCR1 | NM_001295 |
| TCCCTTCTGGATCGACTAC | 263 | chemokine (C-C motif) receptor 1 | CCR1 | NM_001295 |
| CAATTATGAGTCCACGGTC | 264 | olfactory receptor, family 1, subfamily A, member 2 | OR1A2 | NM_012352 NM_014565 |
| AACGATGGGCATGTATTTC | 265 | olfactory receptor, family 1, subfamily A, member 2 | OR1A2 | NM_012352 |
| TGTCTCCTATGTTCAGGTC | 266 | olfactory receptor, family 1, subfamily A, member 2 | OR1A2 | NM_012352 |
| GTATGGACAGAACTGGCTC | 267 | sentrin/SUMO-specific protease 3 | SENP3 | NM_015670 |
| GATGAACATGTATGGAGAC | 268 | sentrin/SUMO-specific protease 3 | SENP3 | NM_015670 |
| ATTCCTTCAAACGTATGGC | 269 | sentrin/SUMO-specific protease 3 | SENP3 | NM_015670 |
| GCTCCTGGAGAACATGTAC | 270 | taste receptor, type 1, member 3 | TAS1R3 | XM_371210 |
| ACCAACCTCAGAGGTTCTC | 271 | thousand and one amino acid protein kinase - prostate derived STE20-like kinase PSK | TAO1 | NM_016151 NM_004783 |
| AAGCGGACCTACAAACTTC | 272 | thousand and one amino acid protein kinase - prostate derived STE20-like kinase PSK | TAO1 | NM_016151 NM_004783 |
| CGTCTACATGTACGTGTTC | 273 | solute carrier family 16 (monocarboxylic acid transporters), member 3 | SLC16A3 | NM_004207 |
| GTGTGTACATCAACTGTTC | 274 | androgen-regulated short-chain dehydrogenase/reductase 1 | ARSDR1 | NM_016026 |
| GGCACAGTCCAATCTGAAC | 275 | androgen-regulated short-chain dehydrogenase/reductase 1 | ARSDR1 | NM_016026 |
| CGCAAGTTCTACTCCATCC | 276 | RAS, dexamethasone-induced 1 | RASD1 | NM_016084 |
| GGTGTTCAGTCTGGACAAC | 277 | RAS, dexamethasone-induced 1 | RASD1 | NM_016084 |
| GTGTTCAGTCTGGACAACC | 278 | RAS, dexamethasone-induced 1 | RASD1 | NM_016084 |
| ACTTGAACTCTCTCCACAC | 279 | chromosome 20 open reading frame 121 | C20orf121 | NM_024331 |
| GTCTTCAATAACTTGAAGC | 280 | chromosome 20 open reading frame 121 | C20orf121 | NM_024331 |

TABLE 1A-continued

| KD TARGET Sequence (5'→3') | SEQ ID NO. | TARGET Gene Name | TARGET Gene Symbol | Genbank DNA/RNA Accession |
|---|---|---|---|---|
| CCACAACAAGCACGTGTTC | 281 | HMT1 hnRNP methyltransferase-like 3 (S. cerevisiae) | HRMT1L3 | NM_019854 |
| ATCAATCGAAAGATTCTTC | 282 | interleukin-1 receptor-associated kinase 2 | IRAK2 | NM_001570 SK180 |
| CGACGTTGACAATTCCAGC | 283 | interleukin-1 receptor-associated kinase 2 | IRAK2 | NM_001570 SK180 |
| GCAGAGTTGCAGATTTGTC | 284 | interleukin-1 receptor-associated kinase 2 | IRAK2 | NM_001570 SK180 |
| TCAGCATTCCTACGATAAC | 285 | glutamate receptor, ionotropic, N-methyl D-aspartate 2A | GRIN2A | NM_000833 |
| CCGGCAGAAGGATAACCTC | 286 | glutamate receptor, ionotropic, N-methyl D-aspartate 2A | GRIN2A | NM_000833 |
| CCAGAACTGTGAAGTTTAC | 287 | glutamate receptor, ionotropic, N-methyl D-aspartate 2A | GRIN2A | NM_000833 |
| GCATGGCAAGAAAGTTAAC | 288 | glutamate receptor, ionotropic, N-methyl D-aspartate 2A | GRIN2A | NM_000833 |
| AGCATGTTATGCCTTATGC | 289 | glutamate receptor, ionotropic, N-methyl D-aspartate 2A | GRIN2A | NM_000833 |
| TCATTGTTTCTGCCATAGC | 290 | glutamate receptor, ionotropic, N-methyl D-aspartate 2A | GRIN2A | NM_000833 |
| GATCTTTAACCAGCCTGAC | 291 | hypothetical protein FLJ22955 | FLJ22955 | NM_024819 |
| GCACACCGTGGTAGTATAC | 292 | hypothetical protein FLJ22955 | FLJ22955 | NM_024819 |
| GTCCTTCCACATCAAGAAC | 293 | tumor endothelial marker 5 precursor | TEM5 | NM_032777 |
| TGCAACCTCTTACCCAAGC | 294 | chloride intracellular channel 6 | CLIC6 | NM_053277 |
| CTCAATCCCTTCGTCTACC | 295 | G protein-coupled receptor 150 | GPR150 | NM_199243 |
| CGTGGTCTACGCGTTCTAC | 296 | LOC167417 | XM_094471 | XM_094471 |
| CATTATCACCATGCTCGGC | 297 | G protein-coupled receptor 150 | GPR150 | NM_199243 |
| TCTCTCTTCCTATCAATCC | 298 | chemokine (C—C motif) receptor 3 | CCR3 | NM_178329 NM_001837 |
| CCAAACGTGTCTGGAAGAC | 299 | G protein-coupled receptor 23 | GPR23 | NM_005296 |
| GTACCTGTAGCCATCTAAC | 300 | G protein-coupled receptor 64 | GPR64 | NM_005756 |
| GCTAGTGAATAATGATTGC | 301 | G protein-coupled receptor 64 | GPR64 | NM_005756 |
| ACACGACTATAAGTCTAAC | 302 | G protein-coupled receptor 64 | GPR64 | NM_005756 |
| ACATTGCAATGGACAACAC | 303 | KIAA0943 protein | APG4B | NM_013325 NM_178326 |
| GGAATATCCTGAGTGTTGC | 304 | dual specificity phosphatase 5 | DUSP5 | NM_004419 |
| TGCCAGAGGGATGAACTAC | 305 | mitogen-activated protein kinase kinase kinase 9 | MAP3K9 | NM_033141 |
| ATGGAAGACTGCTGGAATC | 306 | mitogen-activated protein kinase kinase kinase 9 | MAP3K9 | NM_033141 |
| GAGCGCTTCAAACGAGATC | 307 | mitogen-activated protein kinase kinase kinase 9 | MAP3K9 | NM_033141 |
| ACCTGTCCCTAGATTCTTC | 308 | KIAA0943 protein | APG4B | NM_013325 |
| ACGCATCTTGGCAAAGAGC | 309 | casein kinase 1, gamma 1 | CSNK1G1-CK1g1 | NM_022048 SK647 |
| ATTCCAGGGTTTATGTGTC | 310 | peptidylprolyl isomerase A | PPIA, | XM_372328 |

TABLE 1A-continued

| KD TARGET Sequence (5'→3') | SEQ ID NO. | TARGET Gene Name | TARGET Gene Symbol | Genbank DNA/RNA Accession |
|---|---|---|---|---|
| | | | LOC390006, | XM_371409 |
| | | | LOC388817, | NM_203431 |
| | | | LOC442744, | XM_499491 |
| | | | LOC342541, | XM_292596 |
| | | | LOC344178, | XM_292963 |
| | | | LOC388687, | XM_371304 |
| | | | LOC391352, | XM_372916 |
| | | | LOC256374, | XM_170597 |
| | | | LOC388686, | XM_371302 |
| | | | LOC122335, | NM_021130 |
| | | | LOC390827, | XM_063084 |
| | | | LOC390956, | XM_497571 |
| | | | LOC442362, | XM_372741 |
| | | | LOC343384, | NM_203430 |
| | | | COAS2, | XM_498254 |
| | | | LOC44006, | XM_291544 |
| | | | LOC392352 | NM_178230 |
| | | | | XM_495896 |
| | | | | XM_373301 |
| | | | | XM_060887 |
| | | | | XM_377444 |
| CAACAGTGCATCTCTTATC | 311 | liver-specific organic anion transporter 3 | LST-3 | NM_001009562 (XM_292093) |
| CAGCATCTACCTCCTGAAC | 312 | chemokine (C-C motif) receptor 1 | CCR1 | NM_001295 |
| CAGCGCTCTCAATCCCTTC | 313 | G protein-coupled receptor 150 | GPR150 | NM_199243 |
| CATCGACTATATAGCAGGC | 314 | carboxyl ester lipase (bile salt-stimulated lipase) | CEL | NM_001807 |
| CCAAGAGTCTATTCAAAGC | 315 | olfactory receptor, family 1, subfamily A, member 2 | OR1A2 | NM_012352 |
| CCACTAATGTCAACAATGC | 316 | G protein-coupled receptor 23 | GPR23 | NM_005296 |
| CCACTCGTCAGATGTTTGC | 317 | LOC254378 | LOC254378 | XM_174812 |
| CCCTGTCATTGATGGAGAC | 318 | carboxyl ester lipase (bile salt-stimulated lipase) | CEL | NM_001807 |
| CCGAGCCATATACTTGACC | 319 | chromosome 20 open reading frame 121 | C20orf121 | NM_024331 |
| CCTAGAGCTGATTGAGTTC | 320 | MAP kinase-interacting serine/threonine kinase 2 | MKNK2-MNK2 | NM_199054 NM_017572 SK236 |
| CCTCGACACCAAGTCTTGC | 321 | RAS, dexamethasone-induced 1 | RASD1 | NM_016084 |
| CGCTCTTTAACATGAATGC | 322 | thousand and one amino acid protein kinase - prostate derived STE20-like kinase PSK | TAO1 | NM_016151 NM_004783 |
| CGTGGACATGGAGTACGAC | 323 | taste receptor, type 1, member 3 | TAS1R3 | XM_371210 |
| CTCGTAATGAGACTATAGC | 324 | androgen-regulated short-chain dehydrogenase/reductase 1 | ARSDR1 | NM_016026 |
| CTGCAAATCTTCAGGTTTC | 325 | G protein-coupled receptor 64 | GPR64 | NM_005756 |
| GAAGCACGATTTGGAGGTC | 326 | unc-51-like kinase 1 (*C. elegans*) | ULK1 | NM_003565 |
| GATGATGAAGGAGACGTTC | 327 | hypothetical protein FLJ22955 | FLJ22955 | NM_024819 |
| GATTTGGTTATAAGGGTTC | 328 | peptidylprolyl isomerase A | LOC126170 | XM_497621 |
| | | | LOC388817 | XM_371409 |
| | | | PPIA | NM_203431 |
| | | | KBTBD9 | XM_496546 |
| | | | LOC256374 | XM_170597 |
| | | | LOC131055 | XM_067176 |
| | | | LOC390956 | NM_021130 |
| | | | LOC391062 | XM_372741 |
| | | | LOC343384 | XM_372785 |
| | | | LOC401859 | NM_203430 |

TABLE 1A-continued

| KD TARGET Sequence (5'→3') | SEQ ID NO. | TARGET Gene Name | TARGET Gene Symbol | Genbank DNA/RNA Accession |
|---|---|---|---|---|
| | | | | XM_291544 |
| | | | | XM_377444 |
| GCTACTGCCCTATATGATC | 329 | solute carrier family 39 (zinc transporter), member 4 | SLC39A4 | NM_017767 NM_130849 |
| TCCGGTTCTATTTGATCGC | 330 | tumor endothelial marker 5 precursor | TEM5 | NM_032777 |
| TCGCCCTTCCTATTCCTTC | 331 | mitogen-activated protein kinase kinase kinase 9 | MAP3K9 | NM_033141 |
| TGTACGTGTTCATCCTGGC | 332 | solute carrier family 16 (monocarboxylic acid transporters), member 3 | SLC16A3 | NM_004207 |
| TGTGACATTATGCCTTTGC | 333 | olfactory receptor, family 1, subfamily A, member 2 | OR1A2 | NM_102352 |

TABLE 2

| TARGET Id | KD TARGET SEQ ID NO. | TARGET Gene Symbol | Class | Genbank DNA/RNA Accession | DNA/RNA SEQ ID NO. | Genbank Polypeptide Accession | Polypeptide SEQ ID NO. |
|---|---|---|---|---|---|---|---|
| H24-148 | 147 | CLIC6 | Ion Channel | XM_092804 | 335 | XP_092804 | 377 |
| | | | | NM_053277 | 336 | NP_444501 | 378 |
| H24-159 | 158 | GPR23 | GPCR | NM_005296 | 337 | NP_005287 | 379 |
| H24-160 | 159 | GPR64 | GPCR | NM_005756 | 338 | NP_005747 | 380 |
| H24-142 | 141 | GRIN2A | Receptor | NM_000833 | 339 | NP_000824 | 381 |
| H24-024 | 26 | MMP23A MMP23B | Protease | NM_004659 NM_006983 | 340 341 | NP_004650 NP_008914 | 382 383 |
| H24-054 | 54 | CCR1 | GPCR | NM_001295 | 342 | NP_001286 | 384 |
| H24-128 | 127 | HRMT1L3 | Enzyme | NM_019854 | 343 | NP_062828 | 385 |
| H24-138 | 137 | IRAK2 | Kinase | NM_001570 SK180 | 344 345 | NP_001561 SK180's protein | 386 387 |
| H24-194 | 189 | MAP3K9 | Kinase | NM_033141 XM_027237 | 346 347 | NP_149132 XP_027237 | 388 389 |
| H24-004 | 6 | MKNK2 | Kinase | SK236 NM_017572 NM_199054 | 348 349 350 | SK236's protein NP_060042 NP_951009 | 390 391 392 |
| H24-097 | 96 | TAOK2, PSK, TAO1 | Kinase | NM_016151 NM_004783 | 351 352 | NP_057235 NP_004774 | 393 394 |
| H24-021 | 23 | C13orf6, FLJ14906 | Protease | NM_032859 | 353 | NP_116248 | 395 |
| H24-157 | 156 | CCR3 | GPCR | NM_178329 NM_001837 | 354 355 | NP_847899 NP_001828 | 396 397 |
| H24-006 | 8 | CSNK1G1 | Kinase | NM_001011664 (SK647) NM_022048 | 356 357 | NP_001011664 NP_071331 | 398 399 |
| H24-193 | 188 | DUSP5 | Phosphatase | NM_004419 | 358 | NP_004410 | 400 |
| H24-143 | 142 | FLJ22955 | Kinase | NM_024819 | 359 | NP_079095 | 401 |
| H24-149 | 148 | GPR150 | GPCR | XM_094471 NM_199243 | 360 361 | XP_094471 NP_954713 | 402 403 |
| H24-014 | 16 | GZMK | Protease | NM_002104 | 362 | NP_002095 | 404 |
| H24-064; H24-164 | 63 | OR1A1 | GPCR | NM_014565 | 363 | NP_055380 | 405 |
| H24-064; H24-164 | 63 | OR1A2 | GPCR | NM_012352 | 364 | NP_036484 | 406 |
| H24-112 | 111 | RASD1 | Enzyme | NM_016084 | 365 | NP_057168 | 407 |
| H24-099 | 98 | SLC16A3 | Transporter | NM_004207 | 366 | NP_004198 | 408 |
| H24-049 | 1 | AVPR1B | GPCR | NM_000707 | 367 | NP_000698 | 409 |
| H24-007 | 9 | caMLCK | Kinase | SK536 NM_182493 (AJ247087) | 368 369 | SK536's protein NP_872299 | 410 411 |
| H24-185 | 180 | CYP24A1 | Cytochrome P450 | NM_000782 | 370 | NP_000773 | 412 |
| H24-169 | 164 | GALR2 | GPCR | NM_003857 | 371 | NP_003848 | 413 |
| H24-219 | 214 | KCNG1 | Ion Channel | NM_002237 NM_172318 | 372 373 | NP_002228 NP_758529 | 414 415 |
| H24-094 | 93 | PAK6 | Kinase | NM_020168 SK429 | 374 375 | NP_064553 SK429's protein | 416 417 |

TABLE 2-continued

| TARGET Id | KD TARGET SEQ ID NO. | TARGET Gene Symbol | Class | Genbank DNA/RNA Accession | DNA/RNA SEQ ID NO. | Genbank Polypeptide Accession | Polypeptide SEQ ID NO. |
|---|---|---|---|---|---|---|---|
| H24-041 | 42 | PIK3C2B | Kinase | NM_002646 | 376 | NP_002637 | 418 |
| H24-008 | 10 | ROCK2 | Kinase | NM_004850 | 600 | NP_004841 | 601 |

TABLE 2A

| Accession | Name | Protein Segment | Seq ID protein segment |
|---|---|---|---|
| NP_444507 | CLIC6 | O—ClC: intracellular chloride channel protein | 419 |
| NP_005287 | GPR23 | Extracellular domain | 420 |
| | | Transmembrane domain | 421 |
| | | Intracellular domain | 422 |
| | | Transmembrane domain | 423 |
| | | Extracellular domain | 424 |
| | | Transmembrane domain | 425 |
| | | Intracellular domain | 426 |
| | | Transmembrane domain | 427 |
| | | Extracellular domain | 428 |
| | | Transmembrane domain | 429 |
| | | Intracellular domain | 430 |
| | | Transmembrane domain | 431 |
| | | Extracellular domain | 432 |
| | | Transmembrane domain | 433 |
| | | Intracellular domain | 434 |
| NP_005747 | GPR64 | Extracellular domain | 435 |
| | | Transmembrane domain | 436 |
| | | Intracellular domain | 437 |
| | | Transmembrane domain | 438 |
| | | Extracellular domain | 439 |
| | | Transmembrane domain | 440 |
| | | Intracellular domain | 441 |
| | | Transmembrane domain | 442 |
| | | Extracellular domain | 443 |
| | | Transmembrane domain | 444 |
| | | Intracellular domain | 445 |
| | | Transmembrane domain | 446 |
| | | Extracellular domain | 447 |
| | | Transmembrane domain | 448 |
| | | Intracellular domain | 449 |
| NP_000824 | GRIN2A | Lig_chan | 450 |
| NP_004650 | MMP23A | ZnMc | 451 |
| | | Peptidase_M10 | 452 |
| | | ShKToxin domain | 453 |
| | | Immunoglobulin | 454 |
| NP_008914 | MMP23B | ZnMc | 455 |
| | | Peptidase_M10 | 456 |
| | | ShKToxin domain | 457 |
| | | Immunoglobulin | 458 |
| NP_001286 | CCR1 | Extracellular domain | 459 |
| | | Transmembrane domain | 460 |
| | | Intracellular domain | 461 |
| | | Transmembrane domain | 462 |
| | | Extracellular domain | 463 |
| | | Transmembrane domain | 464 |
| | | Intracellular domain | 465 |
| | | Transmembrane domain | 466 |
| | | Extracellular domain | 467 |
| | | Transmembrane domain | 468 |
| | | Intracellular domain | 469 |
| | | Transmembrane domain | 470 |
| | | Extracellular domain | 471 |
| | | Transmembrane domain | 472 |
| | | Intracellular domain | 473 |
| NP_062828 | HRMT1L3 | Predicted RNA methylase | 474 |
| NP_001561 | IRAK2 | Death domain | 475 |
| SK180's protein | | protein kinase | 476 |
| NP_149132 | MAP3K9 | SH3_1 | 477 |
| XP_027237 | | protein kinase | 478 |
| SK236's protein | MKNK2 | protein kinase | 479 |
| NP_060042 | MKNK2 | protein kinase | 480 |
| NP_951009 | | | |
| NP_057235 | TAOK2 = PSK = TAO1 | protein kinase | 481 |
| NP_004774 | | | |
| NP_116248 | C13orf6 = FLJ14906 | Alpha/beta hydrolase fold-1 | 482 |
| NP_847899 | CCR3 | Rhodopsin-like GPCR superfamily | 483 |
| NP_001828 | | | |
| | | Extracellular domain | 484 |
| | | Transmembrane domain | 485 |
| | | Intracellular domain | 486 |
| | | Transmembrane domain | 487 |
| | | Extracellular domain | 488 |
| | | Transmembrane domain | 489 |
| | | Intracellular domain | 490 |
| | | Transmembrane domain | 491 |
| | | Extracellular domain | 492 |
| | | Transmembrane domain | 493 |
| | | Intracellular domain | 494 |
| | | Transmembrane domain | 495 |
| | | Extracellular domain | 496 |
| | | Transmembrane domain | 497 |
| | | Intracellular domain | 498 |
| NP_001011664 | CSNK1G1 | protein kinase | 499 |
| NP_071331 | | | |
| NP_004410 | DUSP5 | Rhodanese-like | 500 |
| | | Dual specificity protein phosphatase | 501 |
| NP_079095 | FLJ22955 | Dephospho-CoA kinase | 502 |
| XP_094471 | GPR150 | Intracellular domain | 503 |
| | | Transmembrane domain | 504 |
| | | Extracellular domain | 505 |
| | | Transmembrane domain | 506 |
| | | Intracellular domain | 507 |
| | | Transmembrane domain | 508 |
| | | Extracellular domain | 509 |
| | | Transmembrane domain | 510 |
| | | Intracellular domain | 511 |
| NP_954713 | GPR150 | Extracellular domain | 512 |
| | | Transmembrane domain | 513 |
| | | Intracellular domain | 514 |
| | | Transmembrane domain | 515 |
| | | Extracellular domain | 516 |
| | | Intracellular domain | 517 |
| | | Transmembrane domain | 518 |
| | | Transmembrane domain | 519 |
| | | Extracellular domain | 520 |
| | | Transmembrane domain | 521 |
| | | Intracellular domain | 522 |
| NP_002095 | GZMK | Peptidase S1 and S6, chymotrypsin/Hap | 523 |
| NP_055380 | OR1A1 | Extracellular domain | 524 |
| | | Transmembrane domain | 525 |
| | | Intracellular domain | 526 |
| | | Transmembrane domain | 527 |
| | | Extracellular domain | 528 |
| | | Transmembrane domain | 529 |
| | | Intracellular domain | 530 |
| | | Transmembrane domain | 531 |
| | | Extracellular domain | 532 |

TABLE 2A-continued

| Accession | Name | Protein Segment | Seq ID protein segment |
|---|---|---|---|
| | | Transmembrane domain | 533 |
| | | Intracellular domain | 534 |
| | | Transmembrane domain | 535 |
| | | Extracellular domain | 536 |
| | | Transmembrane domain | 537 |
| | | Intracellular domain | 538 |
| NP_036484 | OR1A2 | Extracellular domain | 539 |
| | | Transmembrane domain | 540 |
| | | Intracellular domain | 541 |
| | | Transmembrane domain | 542 |
| | | Extracellular domain | 543 |
| | | Transmembrane domain | 544 |
| | | Intracellular domain | 545 |
| | | Transmembrane domain | 546 |
| | | Extracellular domain | 547 |
| | | Transmembrane domain | 548 |
| | | Intracellular domain | 549 |
| | | Transmembrane domain | 550 |
| | | Extracellular domain | 551 |
| | | Transmembrane domain | 552 |
| | | Intracellular domain | 553 |
| NP_057168 | RASD1 | Ras small GTPase, Ras type | 554 |
| NP_004198 | SLC16A3 | Major facilitator superfamily MFS_1 | 555 |
| NP_000698 | AVPR1B | Extracellular domain | 556 |
| | | Transmembrane domain | 557 |
| | | Intracellular domain | 558 |
| | | Transmembrane domain | 559 |
| | | Extracellular domain | 560 |
| | | Transmembrane domain | 561 |
| | | Intracellular domain | 562 |
| | | Transmembrane domain | 563 |
| | | Extracellular domain | 564 |
| | | Transmembrane domain | 565 |
| | | Intracellular domain | 566 |
| | | Transmembrane domain | 567 |
| | | Extracellular domain | 568 |
| | | Transmembrane domain | 569 |
| | | Intracellular domain | 570 |
| SK536's protein | caMLCK | Protein kinase | 571 |
| NP_872299 | caMLCK | Serine/threonine protein kinase | 572 |
| NP_000773 | CYP24A1 | Cytochrome P450 | 573 |
| NP_003848 | GALR2 | Extracellular domain | 574 |
| | | Transmembrane domain | 575 |
| | | Intracellular domain | 576 |
| | | Transmembrane domain | 577 |
| | | Extracellular domain | 578 |
| | | Transmembrane domain | 579 |
| | | Intracellular domain | 580 |
| | | Transmembrane domain | 581 |
| | | Extracellular domain | 582 |
| | | Transmembrane domain | 583 |
| | | Intracellular domain | 584 |
| | | Transmembrane domain | 585 |
| | | Extracellular domain | 586 |
| | | Transmembrane domain | 587 |
| | | Intracellular domain | 588 |
| NP_002228 | KCNG1 | K+ channel tetramerisation | 589 |
| | | Ion transport | 590 |
| NP_758529 | KCNG1 | K+ channel tetramerisation | 591 |
| NP_064553 SK429's protein | PAK6 | PAK-box/P21-Rho-binding | 592 |
| | | Serine/threonine protein kinase | 593 |
| NP_002637 | PIK3C2B | Phosphoinositide 3-kinase, ras-binding | 594 |
| | | Phosphoinositide 3-kinase, C2 | 595 |
| | | Phosphoinositide 3-kinase accessory region PIK | 596 |
| | | Phosphatidylinositol 3- and 4-kinase, catalytic | 597 |
| | | Phox-like | 598 |
| | | C2 | 599 |
| NP_004841 | ROCK2 | Serine/threonine protein kinase | 602 |
| | | Protein kinase, C-terminal | 603 |
| | | PKN/rhophilin/rhotekin rho-binding repeat | 604 |
| | | Pleckstrin-like | 605 |
| | | Protein kinase C, phorbol ester/diacyl-glycerol binding | 606 |

Table 3 lists the preferred loop sequence for a shRNA.

TABLE 3

| Name | Sequence | SEQ ID NO: |
|---|---|---|
| Loop region | GTTTGCTATAAC | 334 |

The present invention relates to a method for assaying for compounds that induce osteoblast differentiation, comprising contacting the compound with a polypeptide comprising an amino acid sequence of the polypeptides of SEQ ID NO: 377-599, 601-606, 867-1119, 1123-1133 ("TARGETS") under conditions that allow said polypeptide to bind to the compound, and detecting the formation of a complex between the polypeptide and the compound. One preferred means of measuring the complex formation is to determine the binding affinity of said compound to said polypeptide.

More particularly, the invention relates to a method for identifying an agent that induces differentiation of undifferentiated mammalian cells into osteoblasts, the method comprising further:

(a) contacting a population of undifferentiated vertebrate cells with one or more of said compound that exhibits binding affinity for said TARGETS, and (b) measuring a compound-polypeptide property related to the differentiation of said cells into osteoblasts.

The compound-polypeptide property referred to above is related to the differentiation of cells into osteoblasts, and is a measurable phenomenon chosen by the person of ordinary skill in the art. The measurable property may e.g. be the binding affinity for a peptide domain of the polypeptide TARGET or the level of any one of a number of biochemical marker levels of osteoblast differentiation. Osteoblast differentiation can e.g. be measured by measuring the level of enzymes that are induced during the differentiation process, such as alkaline phosphatase, type-1 collagen, osteocalcin and osteopontin. The alkaline phosphatase activity can be measured by adding methylumbelliferyl heptaphosphate (MUP) solution (Sigma) to the cells. The fluorescence generated upon cleavage of the MUP substrate by the AP activity is measured on a fluorescence plate reader (Fluostar, BMG).

In a preferred embodiment of the invention, the polypeptide TARGET comprises an amino acid sequence selected from the group consisting of SEQ ID NO: 377-599, 601-606, 867-1119, 1123-1133 (Tables 1, 2, and 2A). In another preferred embodiment of the invention, the polypeptide TAR- GET comprises an amino acid sequence selected from the group consisting of SEQ ID NO: 377-599, 601-606 (Tables 2 and 2A).

A preferred class of the polypeptides used as TARGETS are G-Protein Coupled Receptors (GPCR), wherein the expression and/or activity of said GPCR may be measured by determining the level of any one of the second messengers cyclic AMP, $Ca^{2+}$ or both. Preferably, the level of the second messenger is determined with a reporter gene under the control of a promoter that is responsive to the second messenger. More preferably, the promoter is a cyclic AMP-responsive promoter, an NF-KB responsive promoter, or a NF-AT responsive promoter. In another preferred embodiment, the reporter gene is selected from the group consisting of: alkaline phosphatase, GFP, eGFP, dGFP, luciferase and b-galactosidase.

Other preferred classes of polypeptides used as TARGETS include kinases and phosphatases. Kinases are enzymes that transfer phosphate groups from high-energy donor molecules, such as ATP, to specific target molecules (substrates); the process is termed phosphorylation. Phosphatases remove phosphate groups from substrates. The activity of kinases or phosphatases may be measured by determining the level of phosphorylation or dephosphorylation of a substrate of said polypeptide. It is well known in the art how to measure this activity by using the respective substrate and to perform assays in which the substrate gets phosphorylated or dephosphorylated upon activation of the kinase or phosphatase. This means that the activity of the kinase or phosphatase can easily be scored through the phosphorylation status of its substrate.

Another preferred class of polypeptides used as TARGETS are proteases. Proteases are enzymes that break peptide bonds between amino acids of proteins; the process is called proteolytic cleavage. Protease activity can be measured through the level of cleavage of the respective substrate, which is a preferred method according to the invention to determine the activity level of the protease. Classically, substrates are used in which a fluorescent group is linked to a quencher through a peptide sequence that is a substrate that can be cleaved by the target protease. Cleavage of the linker separates the fluorescent group and quencher, giving rise to an increase in fluorescence.

Another preferred class of polypeptides used as TARGETS are ion channels. Ion channels are membrane protein complexes and their function is to facilitate the diffusion of ions across biological membranes. Membranes, or phospholipid bilayers, build a hydrophobic, low dielectric barrier to hydrophilic and charged molecules. Ion channels provide a high conducting, hydrophilic pathway across the hydrophobic interior of the membrane. The activity of an ion channel can be measured using classical patch clamping. High-throughput fluorescence-based or tracer-based assays are also widely available to measure ion channel activity. These fluorescent-based assays screen compounds on the basis of their ability to either open or close an ion channel thereby changing the concentration of specific fluorescent dyes across a membrane. In the case of the tracer based assay, the changes in concentration of the tracer within and outside the cell are measured by radioactivity measurement or gas absorption spectrometry.

Depending on the choice of the skilled artisan, the present assay method may be designed to function as a series of measurements, each of which is designed to determine whether the drug candidate compound is indeed acting on the polypeptide to thereby induce the differentiation of undifferentiated cells into osteoblasts. For example, an assay designed to determine the binding affinity of a compound to the polypeptide, or fragment thereof, may be necessary, but not sufficient, to ascertain whether the test compound would be useful for increasing mean bone density when administered to a subject. Nonetheless, such binding information would be useful in identifying a set of test compounds for use in an assay that would measure a different property, further down the biochemical pathway, such as bone mineralization, assayed by measuring the amount of deposited calcium. Such second assay may be designed to confirm that the test compound, having binding affinity for the polypeptide, actually induces the differentiation of undifferentiated cells into osteoblasts. Suitable controls should always be in place to insure against false positive readings.

The order of taking these measurements is not believed to be critical to the practice of the present invention, which may be practiced in any order. For example, one may first perform a screening assay of a set of compounds for which no information is known respecting the compounds' binding affinity for the polypeptide. Alternatively, one may screen a set of compounds identified as having binding affinity for a polypeptide domain, or a class of compounds identified as being an inhibitor of the polypeptide. However, for the present assay to be meaningful to the ultimate use of the drug candidate compounds, a measurement of bone alkaline phosphatase levels or bone mineralization is necessary. Validation studies including controls, and measurements of binding affinity to the polypeptides of the invention are nonetheless useful in identifying a compound useful in any therapeutic or diagnostic application.

The binding affinity of the compound with the polypeptide TARGET can be measured by methods known in the art, such as using surface plasmon resonance biosensors (Biacore), by saturation binding analysis with a labeled compound (e.g. Scatchard and Lindmo analysis), by differential UV spectrophotometer, fluorescence polarization assay, Fluorometric Imaging Plate Reader (FLIPR®) system, Fluorescence resonance energy transfer, and Bioluminescence resonance energy transfer. The binding affinity of compounds can also be expressed in dissociation constant (Kd) or as IC50 or EC50. The IC50 represents the concentration of a compound that is required for 50% inhibition of binding of another ligand to the polypeptide. The EC50 represents the concentration required for obtaining 50% of the maximum effect in any assay that measures TARGET function. The dissociation constant, Kd, is a measure of how well a ligand binds to the polypeptide, it is equivalent to the ligand concentration required to saturate exactly half of the binding-sites on the polypeptide. Compounds with a high affinity binding have low Kd, IC50 and EC50 values, i.e. in the range of 100 nM to 1 pM; a moderate to low affinity binding relates to a high Kd, IC50 and EC50 values, i.e. in the micromolar range.

The present assay method may also be practiced in a cellular assay, A host cell expressing TARGET can be a cell with endogenous expression or a cell over-expressing the TARGET e.g. by transduction. When the endogenous expression of the polypeptide is not sufficient to determine a baseline that can easily be measured, one may use host cells that over-express TARGET. Over-expression has the advantage that the level of the TARGET substrate end products is higher than the activity level by endogenous expression. Accordingly, measuring such levels using presently available techniques is easier. In such cellular assay, the biological activity of TARGET may be measured by following the production of bone alkaline phosphatase (BAP) or bone mineralization.

The present invention further relates to a method for identifying a compound that induces differentiation of undifferentiated mammalian cells into osteoblasts, comprising:

(a) contacting a compound with a polypeptide comprising an amino acid sequence selected from the group consisting of SEQ ID NO: 377-599, 601-606, 867-1119, 1123-1133;

(b) determining the binding affinity of the compound to the polypeptide;

(c) contacting a population of mammalian cells expressing said polypeptide with the compound that exhibits a binding affinity of at least 10 micromolar; and (d) identifying the compound that induces the differentiation of said undifferentiated cells.

For high-throughput purposes, libraries of compounds may be used such as antibody fragment libraries, peptide phage display libraries, peptide libraries (e.g. LOPAP™, Sigma Aldrich), lipid libraries (BioMol), synthetic compound libraries (e.g. LOPAC™, Sigma Aldrich) or natural compound libraries (Specs, TimTec).

Preferred drug candidate compounds are low molecular weight compounds. Low molecular weight compounds, i.e. with a molecular weight of 500 Dalton or less, are likely to have good absorption and permeation in biological systems and are consequently more likely to be successful drug candidates than compounds with a molecular weight above 500 Dalton (Lipinski et al. (1997)). Peptides comprise another preferred class of drug candidate compounds. Peptides may be excellent drug candidates and there are multiple examples of commercially valuable peptides such as fertility hormones and platelet aggregation inhibitors. Natural compounds are another preferred class of drug candidate compound. Such compounds are found in and extracted from natural sources, and which may thereafter be synthesized. The lipids are another preferred class of drug candidate compound.

Another preferred class of drug candidate compounds is an antibody. The present invention also provides antibodies directed against a TARGET. These antibodies may be endogenously produced to bind to the TARGET within the cell, or added to the tissue to bind to TARGET polypeptide present outside the cell. These antibodies may be monoclonal antibodies or polyclonal antibodies. The present invention includes chimeric, single chain, and humanized antibodies, as well as FAb fragments and the products of a FAb expression library, and Fv fragments and the products of an Fv expression library.

In certain embodiments, polyclonal antibodies may be used in the practice of the invention. The skilled artisan knows methods of preparing polyclonal antibodies. Polyclonal antibodies can be raised in a mammal, for example, by one or more injections of an immunizing agent and, if desired, an adjuvant. Typically, the immunizing agent and/or adjuvant will be injected in the mammal by multiple subcutaneous or intraperitoneal injections. Antibodies may also be generated against the intact TARGET protein or polypeptide, or against a fragment, derivatives including conjugates, or other epitope of the TARGET protein or polypeptide, such as the TARGET embedded in a cellular membrane, or a library of antibody variable regions, such as a phage display library.

It may be useful to conjugate the immunizing agent to a protein known to be immunogenic in the mammal being immunized. Examples of such immunogenic proteins include but are not limited to keyhole limpet hemocyanin, serum albumin, bovine thyroglobulin, and soybean trypsin inhibitor. Examples of adjuvants that may be employed include Freund's complete adjuvant and MPL-TDM adjuvant (monophosphoryl Lipid A, synthetic trehalose dicorynomycolate). One skilled in the art without undue experimentation may select the immunization protocol.

In some embodiments, the antibodies may be monoclonal antibodies. Monoclonal antibodies may be prepared using methods known in the art. The monoclonal antibodies of the present invention may be "humanized" to prevent the host from mounting an immune response to the antibodies. A "humanized antibody" is one in which the complementarity determining regions (CDRs) and/or other portions of the light and/or heavy variable domain framework are derived from a non-human immunoglobulin, but the remaining portions of the molecule are derived from one or more human immunoglobulins. Humanized antibodies also include antibodies characterized by a humanized heavy chain associated with a donor or acceptor unmodified light chain or a chimeric light chain, or vice versa. The humanization of antibodies may be accomplished by methods known in the art (see, e.g. Mark and Padlan, (1994) "Chapter 4. Humanization of Monoclonal Antibodies", The Handbook of Experimental Pharmacology Vol. 113, Springer-Verlag, New York). Transgenic animals may be used to express humanized antibodies.

Human antibodies can also be produced using various techniques known in the art, including phage display libraries (Hoogenboom and Winter, (1991) J. Mol. Biol. 227:381-8; Marks et al. (1991). J. Mol. Biol. 222:581-97). The techniques of Cole, et al. and Boerner, et al. are also available for the preparation of human monoclonal antibodies (Cole, et al. (1985) Monoclonal Antibodies and Cancer Therapy, Alan R. Liss, p. 77; Boerner, et al (1991). J. Immunol., 147(1):86-95).

Techniques known in the art for the production of single chain antibodies can be adapted to produce single chain antibodies to the TARGET polypeptides and proteins of the present invention. The antibodies may be monovalent antibodies. Methods for preparing monovalent antibodies are well known in the art. For example, one method involves recombinant expression of immunoglobulin light chain and modified heavy chain. The heavy chain is truncated generally at any point in the Fc region so as to prevent heavy chain cross-linking. Alternatively; the relevant cysteine residues are substituted with another amino acid residue or are deleted so as to prevent cross-linking.

Bispecific antibodies are monoclonal, preferably human or humanized, antibodies that have binding specificities for at least two different antigens and preferably for a cell-surface protein or receptor or receptor subunit. In the present case, one of the binding specificities is for one domain of the TARGET; the other one is for another domain of the same or different TARGET.

Methods for making bispecific antibodies are known in the art. Traditionally, the recombinant production of bispecific antibodies is based on the co-expression of two immunoglobulin heavy-chain/light-chain pairs, where the two heavy chains have different specificities (Milstein and Cuello, (1983) Nature 305:537-9). Because of the random assortment of immunoglobulin heavy and light chains, these hybridomas (quadromas) produce a potential mixture of ten different antibody molecules, of which only one has the correct bispecific structure. Affinity chromatography steps usually accomplish the purification of the correct molecule. Similar procedures are disclosed in Trauneeker, et al. (1991) EMBO J. 10:3655-9.

According to another preferred embodiment, the assay method uses a drug candidate compound identified as having a binding affinity for a TARGET, and/or has already been identified as having down-regulating activity such as antagonist activity vis-à-vis one or more TARGET.

The present invention further relates to a method for inducing differentiation of undifferentiated mammalian cells into osteoblasts comprising contacting said cells with an expression inhibitory agent comprising a polynucleotide sequence that complements at least about 17 nucleotides of the polyribonucleotide comprising a nucleotide sequence selected from the group consisting of SEQ ID NO: 335-376, 600, 607-866, 1120-1122.

Another aspect of the present invention relates to a method for inducing the differentiation of undifferentiated mammalian cells into osteoblasts, comprising by contacting said cell with an expression-inhibiting agent that inhibits the translation in the cell of a polyribonucleotide encoding a TARGET polypeptide. A particular embodiment relates to a composition comprising a polynucleotide including at least one antisense strand that functions to pair the agent with the TARGET mRNA, and thereby down-regulate or block the expression of TARGET polypeptide. The inhibitory agent preferably comprises antisense polynucleotide, a ribozyme, and a small interfering RNA (siRNA), wherein said agent comprises a nucleic acid sequence complementary to, or engineered from, a naturally-occurring polynucleotide sequence encoding a portion of a polypeptide comprising an amino acid sequence selected from the group consisting of SEQ ID NO: 377-418, 601, 867-1119, 1123-1133. In a preferred embodiment the expression-inhibiting agent is complementary to a polynucleotide sequence selected from the group consisting of SEQ ID NO: 335-376, 600, 607-866, 1120-1122. In another preferred embodiment the expression-inhibiting agent is complementary to a polynucleotide sequence selected from the group consisting of SEQ ID NO: 1-220, 247-333.

An embodiment of the present invention relates to a method wherein the expression-inhibiting agent is selected from the group consisting of antisense RNA, antisense oligodeoxynucleotide (ODN), a ribozyme that cleaves the polyribonucleotide coding for SEQ ID NO: 377-418, 601, 867-1119, 1123-1133, a small interfering RNA (siRNA, preferably shRNA,) that is sufficiently complementary to a portion of the polyribonucleotide coding for SEQ ID NO: 377-418, 601, 867-1119, 1123-1133, such that the siRNA, preferably shRNA, interferes with the translation of the TARGET polyribonucleotide to the TARGET polypeptide. Preferably the expression-inhibiting agent is an antisense RNA, ribozyme, antisense oligodeoxynucleotide, or siRNA, preferably shRNA, complementary to a nucleotide sequence selected from the group consisting of SEQ ID NO: 335-376, 600, 607-866, 1120-1122.

A special embodiment of the present invention relates to a method wherein the expression-inhibiting agent is a nucleic acid expressing the antisense RNA, antisense oligodeoxynucleotide (ODN), a ribozyme that cleaves the polyribonucleotide coding for SEQ ID NO: 377-418, 601, a small interfering RNA (siRNA, preferably shRNA,) that is sufficiently complementary to a portion of the polyribonucleotide corresponding to SEQ ID NO: 377-418, 601, such that the siRNA, preferably shRNA, interferes with the translation of the TARGET polyribonucleotide to the TARGET polypeptide. Preferably the nucleotide sequence is complementary to a polynucleotide selected from the group consisting of SEQ ID NO: 335-376, 600. In another preferred embodiment nucleotide sequence is complementary to a polynucleotide selected from the group consisting of SEQ ID NO: 1, 6, 8, 9, 10, 16, 23, 26, 42, 54, 63, 93, 96, 98, 111, 127, 137, 141, 142, 147, 148, 156, 158, 159, 164, 180, 188, 189, 214.

The down regulation of gene expression using antisense nucleic acids can be achieved at the translational or transcriptional level. Antisense nucleic acids of the invention are preferably nucleic acid fragments capable of specifically hybridizing with all or part of a nucleic acid encoding a TARGET polypeptide or the corresponding messenger RNA. In addition, antisense nucleic acids may be designed which decrease expression of the nucleic acid sequence capable of encoding a TARGET polypeptide by inhibiting splicing of its primary transcript. Any length of antisense sequence is suitable for practice of the invention so long as it is capable of down-regulating or blocking expression of a nucleic acid coding for a TARGET. Preferably, the antisense sequence is at least about 17 nucleotides in length. The preparation and use of antisense nucleic acids, DNA encoding antisense RNAs and the use of oligo and genetic antisense is known in the art.

One embodiment of expression-inhibitory agent is a nucleic acid that is antisense to a nucleic acid comprising SEQ ID NO: 335-376, 600, 607-866, 1120-1122. For example, an antisense nucleic acid (e.g. DNA) may be introduced into cells in vitro, or administered to a subject in vivo, as gene therapy to inhibit cellular expression of nucleic acids comprising SEQ ID NO: 335-376, 600, 607-866, 1120-1122. Antisense oligonucleotides preferably comprise a sequence containing from about 17 to about 100 nucleotides and more preferably the antisense oligonucleotides comprise from about 18 to about 30 nucleotides. Antisense nucleic acids may be prepared from about 10 to about 30 contiguous nucleotides complementary to a nucleic acid sequence selected from the sequences of SEQ ID NO: 335-376, 600, 607-866, 1120-1122.

The antisense nucleic acids are preferably oligonucleotides and may consist entirely of deoxyribo-nucleotides, modified deoxyribonucleotides, or some combination of both. The antisense nucleic acids can be synthetic oligonucleotides. The oligonucleotides may be chemically modified, if desired, to improve stability and/or selectivity. Since oligonucleotides are susceptible to degradation by intracellular nucleases, the modifications can include, for example, the use of a sulfur group to replace the free oxygen of the phosphodiester bond. This modification is called a phosphorothioate linkage. Phosphorothioate antisense oligonucleotides are water soluble, polyanionic, and resistant to endogenous nucleases. In addition, when a phosphorothioate antisense oligonucleotide hybridizes to its TARGET site, the RNA-DNA duplex activates the endogenous enzyme ribonuclease (RNase) H, which cleaves the mRNA component of the hybrid molecule.

In addition, antisense oligonucleotides with phosphoramidite and polyamide (peptide) linkages can be synthesized. These molecules should be very resistant to nuclease degradation. Furthermore, chemical groups can be added to the 2' carbon of the sugar moiety and the 5 carbon (C-5) of pyrimidines to enhance stability and facilitate the binding of the antisense oligonucleotide to its TARGET site. Modifications may include 2'-deoxy, O-pentoxy, O-propoxy, O-methoxy, fluoro, methoxyethoxy phosphorothioates, modified bases, as well as other modifications known to those of skill in the art.

Another type of expression-inhibitory agent that reduces the levels of TARGETS is the ribozyme. Ribozymes are catalytic RNA molecules (RNA enzymes) that have separate catalytic and substrate binding domains. The substrate binding sequence combines by nucleotide complementarity and, possibly, non-hydrogen bond interactions with its TARGET sequence. The catalytic portion cleaves the TARGET RNA at a specific site. The substrate domain of a ribozyme can be engineered to direct it to a specified mRNA sequence. The ribozyme recognizes and then binds a TARGET mRNA through complementary base pairing. Once it is bound to the correct TARGET site, the ribozyme acts enzymatically to cut the TARGET mRNA. Cleavage of the mRNA by a ribozyme destroys its ability to direct synthesis of the corresponding polypeptide. Once the ribozyme has cleaved its TARGET sequence, it is released and can repeatedly bind and cleave at other mRNAs.

Ribozyme forms include a hammerhead motif, a hairpin motif, a hepatitis delta virus, group I intron or RNaseP RNA (in association with an RNA guide sequence) motif or Neurospora VS RNA motif. Ribozymes possessing a hammerhead or hairpin structure are readily prepared since these catalytic RNA molecules can be expressed within cells from eukaryotic promoters (Chen, et al. (1992) Nucleic Acids Res. 20:4581-9). A ribozyme of the present invention can be expressed in eukaryotic cells from the appropriate DNA vector. If desired, the activity of the ribozyme may be augmented by its release from the primary transcript by a second ribozyme (Ventura, et al. (1993) Nucleic Acids Res. 21:3249-55).

Ribozymes may be chemically synthesized by combining an oligodeoxyribonucleotide with a ribozyme catalytic domain (20 nucleotides) flanked by sequences that hybridize to the TARGET mRNA after transcription. The oligodeoxyribonucleotide is amplified by using the substrate binding sequences as primers. The amplification product is cloned into a eukaryotic expression vector.

Ribozymes are expressed from transcription units inserted into DNA, RNA, or viral vectors. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on nearby gene regulatory sequences. Prokaryotic RNA polymerase promoters are also used, providing that the prokaryotic RNA polymerase enzyme is expressed in the appropriate cells (Gao and Huang, (1993) Nucleic Acids Res. 21:2867-72). It has been demonstrated that ribozymes expressed from these promoters can function in mammalian cells (Kashani-Sabet, et al. (1992) Antisense Res. Dev. 2:3-15).

A particularly preferred inhibitory agent is a small interfering RNA (siRNA, preferably shRNA). siRNA, preferably shRNA, mediate the post-transcriptional process of gene silencing by double stranded RNA (dsRNA) that is homologous in sequence to the silenced RNA. siRNA according to the present invention comprises a sense strand of 17-25 nucleotides complementary or homologous to a contiguous 17-25 nucleotide sequence selected from the group of sequences described in SEQ ID NO: 335-376, 600, 607-866, 1120-1122, preferably from the group of sequences described in SEQ ID No: 335-376, 600, and an antisense strand of 17-23 nucleotides complementary to the sense strand. Exemplary sequences are described as sequences complementary to SEQ ID NO: 1-220, 247-333. The most preferred siRNA comprises sense and anti-sense strands that are 100 per cent complementary to each other and the TARGET polynucleotide sequence. Preferably the siRNA further comprises a loop region linking the sense and the antisense strand.

A self-complementing single stranded siRNA molecule polynucleotide according to the present invention comprises a sense portion and an antisense portion connected by a loop region linker. Preferably, the loop region sequence is 4-30 nucleotides long, more preferably 5-15 nucleotides long and most preferably 12 nucleotides long. In a most preferred embodiment the linker sequence is GTTTGCTATAAC (SEQ ID NO: 334). Self-complementary single stranded siRNAs form hairpin loops and are more stable than ordinary dsRNA. In addition, they are more easily produced from vectors.

Analogous to antisense RNA, the siRNA can be modified to confirm resistance to nucleolytic degradation, or to enhance activity, or to enhance cellular distribution, or to enhance cellular uptake, such modifications may consist of modified internucleoside linkages, modified nucleic acid bases, modified sugars and/or chemical linkage the siRNA to one or more moieties or conjugates. The nucleotide sequences are selected according to siRNA designing rules that give an improved reduction of the TARGET sequences compared to nucleotide sequences that do not comply with these siRNA designing rules (For a discussion of these rules and examples of the preparation of siRNA, WO2004094636, published Nov. 4, 2004, and UA20030198627, are hereby incorporated by reference).

The present invention also relates to compositions, and methods using said compositions, comprising a DNA expression vector capable of expressing a polynucleotide capable of inducing osteoblast differentiation and described hereinabove as an expression inhibition agent.

A special aspect of these compositions and methods relates to the down-regulation or blocking of the expression of a TARGET polypeptide by the induced expression of a polynucleotide encoding an intracellular binding protein that is capable of selectively interacting with the TARGET polypeptide. An intracellular binding protein includes any protein capable of selectively interacting, or binding, with the polypeptide in the cell in which it is expressed and neutralizing the function of the polypeptide. Preferably, the intracellular binding protein is a neutralizing antibody or a fragment of a neutralizing antibody having binding affinity to an epitope of the TARGET polypeptide of SEQ ID NO: 377-599, 601-606, 867-1119, 1123-1133, preferably SEQ ID NO: 377-599, 601-606. More preferably, the intracellular binding protein is a single chain antibody.

A special embodiment of this composition comprises the expression-inhibiting agent selected from the group consisting of antisense RNA, antisense oligodeoxynucleotide (ODN), a ribozyme that cleaves the polyribonucleotide coding for SEQ ID NO: 377-418, 601, 867-1119, 1123-1133, preferably SEQ ID NO: 377-418, 601, and a small interfering RNA (siRNA) that is sufficiently homologous to a portion of the polyribonucleotide coding for SEQ ID NO: 377-418, 601, 867-1119, 1123-1133, preferably SEQ ID NO: 377-418, 601, such that the siRNA interferes with the translation of the TARGET polyribonucleotide to the TARGET polypeptide.

The polynucleotide expressing the expression-inhibiting agent is preferably included within a vector. The polynucleic acid is operably linked to signals enabling expression of the nucleic acid sequence and is introduced into a cell utilizing, preferably, recombinant vector constructs, which will express the antisense nucleic acid once the vector is introduced into the cell. A variety of viral-based systems are available, including adenoviral, retroviral, adeno-associated viral, lentiviral, herpes simplex viral or a sendaviral vector systems, and all may be used to introduce and express polynucleotide sequence for the expression-inhibiting agents in TARGET cells.

Preferably, the viral vectors used in the methods of the present invention are replication defective. Such replication defective vectors will usually pack at least one region that is necessary for the replication of the virus in the infected cell. These regions can either be eliminated (in whole or in part), or be rendered non-functional by any technique known to a person skilled in the art. These techniques include the total removal, substitution, partial deletion or addition of one or more bases to an essential (for replication) region. Such techniques may be performed in vitro (on the isolated DNA) or in situ, using the techniques of genetic manipulation or by treatment with mutagenic agents. Preferably, the replication defective virus retains the sequences of its genome, which are necessary for encapsidating, the viral particles.

In a preferred embodiment, the viral element is derived from an adenovirus. Preferably, the vehicle includes an adenoviral vector packaged into an adenoviral capsid, or a functional part, derivative, and/or analogue thereof. Adenovirus biology is also comparatively well known on the molecular level. Many tools for adenoviral vectors have been and continue to be developed, thus making an adenoviral capsid a preferred vehicle for incorporating in a library of the invention. An adenovirus is capable of infecting a wide variety of cells. However, different adenoviral serotypes have different preferences for cells. To combine and widen the TARGET cell population that an adenoviral capsid of the invention can enter in a preferred embodiment, the vehicle includes adenoviral fiber proteins from at least two adenoviruses. Preferred adenoviral fiber protein sequences are serotype 17, 45 and 51. Techniques or construction and expression of these chimeric vectors are disclosed in US Published Patent Applications 20030180258 and 20040071660, hereby incorporated by reference.

In a preferred embodiment, the nucleic acid derived from an adenovirus includes the nucleic acid encoding an adenoviral late protein or a functional part, derivative, and/or analogue thereof. An adenoviral late protein, for instance an adenoviral fiber protein, may be favorably used to TARGET the vehicle to a certain cell or to induce enhanced delivery of the vehicle to the cell. Preferably, the nucleic acid derived from an adenovirus encodes for essentially all adenoviral late proteins, enabling the formation of entire adenoviral capsids or functional parts, analogues, and/or derivatives thereof. Preferably, the nucleic acid derived from an adenovirus includes the nucleic acid encoding adenovirus E2A or a functional part, derivative, and/or analogue thereof. Preferably, the nucleic acid derived from an adenovirus includes the nucleic acid encoding at least one E4-region protein or a functional part, derivative, and/or analogue thereof, which facilitates, at least in part, replication of an adenoviral derived nucleic acid in a cell. The adenoviral vectors used in the examples of this application are exemplary of the vectors useful in the present method of treatment invention.

Certain embodiments of the present invention use retroviral vector systems. Retroviruses are integrating viruses that infect dividing cells, and their construction is known in the art. Retroviral vectors can be constructed from different types of retrovirus, such as, MoMuLV ("murine Moloney leukemia virus" MSV ("murine Moloney sarcoma virus"), HaSV ("Harvey sarcoma virus"); SNV ("spleen necrosis virus"); RSV ("Rous sarcoma virus") and Friend virus. Lentiviral vector systems may also be used in the practice of the present invention.

In other embodiments of the present invention, adenoassociated viruses ("AAV") are utilized. The AAV viruses are DNA viruses of relatively small size that integrate, in a stable and site-specific manner, into the genome of the infected cells. They are able to infect a wide spectrum of cells without inducing any effects on cellular growth, morphology or differentiation, and they do not appear to be involved in human pathologies.

In the vector construction, the polynucleotide agents of the present invention may be linked to one or more regulatory regions. Selection of the appropriate regulatory region or regions is a routine matter, within the level of ordinary skill in the art. Regulatory regions include promoters, and may include enhancers, suppressors, etc.

Promoters that may be used in the expression vectors of the present invention include both constitutive promoters and regulated (inducible) promoters. The promoters may be prokaryotic or eukaryotic depending on the host. Among the prokaryotic (including bacteriophage) promoters useful for practice of this invention are lac, lacZ, T3, T7, lambda $P_r$, $P_l$, and trp promoters. Among the eukaryotic (including viral) promoters useful for practice of this invention are ubiquitous promoters (e.g. HPRT, vimentin, actin, tubulin), intermediate filament promoters (e.g. desmin, neurofilaments, keratin, GFAP), therapeutic gene promoters (e.g. MDR type, CFTR, factor VIII), tissue-specific promoters (e.g. actin promoter in smooth muscle cells, or Flt and Flk promoters active in endothelial cells), including animal transcriptional control regions, which exhibit tissue specificity and have been utilized in transgenic animals: elastase I gene control region which is active in pancreatic acinar cells (Swift, et al. (1984) Cell 38:639-46; Omitz, et al. (1986) Cold Spring Harbor Symp. Quant. Biol. 50:399-409; MacDonald, (1987) Hepatology 7:425-515); insulin gene control region which is active in pancreatic beta cells (Hanahan, (1985) Nature 315:115-22), immunoglobulin gene control region which is active in lymphoid cells (Grosschedl, et al. (1984) Cell 38:647-58; Adames, et al. (1985) Nature 318:533-8; Alexander, et al. (1987) Mol. Cell. Biol. 7:1436-44), mouse mammary tumor virus control region which is active in testicular, breast, lymphoid and mast cells (Leder, et al. (1986) Cell 45:485-95), albumin gene control region which is active in liver (Pinkert, et al. (1987) Genes and Devel. 1:268-76), alpha-fetoprotein gene control region which is active in liver (Krumlauf, et al. (1985) Mol. Cell. Biol., 5:1639-48; Hammer, et al. (1987) Science 235:53-8), alpha 1-antitrypsin gene control region which is active in the liver (Kelsey, et al. (1987) Genes and Devel., 1: 161-71), beta-globin gene control region which is active in myeloid cells (Mogram, et al. (1985) Nature 315: 338-40; Kollias, et al. (1986) Cell 46:89-94), myelin basic protein gene control region which is active in oligodendrocyte cells in the brain (Readhead, et al. (1987) Cell 48:703-12), myosin light chain-2 gene control region which is active in skeletal muscle (Sani, (1985) Nature 314.283-6), and gonadotropic releasing hormone gene control region which is active in the hypothalamus (Mason, et al. (1986) Science 234:1372-8).

Other promoters which may be used in the practice of the invention include promoters which are preferentially activated in dividing cells, promoters which respond to a stimulus (e.g. steroid hormone receptor, retinoic acid receptor), tetracycline-regulated transcriptional modulators, cytomegalovirus immediate-early, retroviral LTR, metallothionein, SV40, E1a, and MLP promoters.

Additional vector systems include the non-viral systems that facilitate introduction of polynucleotide agents into a patient. For example, a DNA vector encoding a desired sequence can be introduced in vivo by lipofection. Synthetic cationic lipids designed to limit the difficulties encountered with liposome-mediated transfection can be used to prepare liposomes for in vivo transfection of a gene encoding a marker (Felgner, et. al. (1987) Proc. Natl. Acad Sci. USA 84:7413-7); see Mackey, et al. (1988) Proc. Natl. Acad. Sci. USA 85:8027-31; Ulmer, et al. (1993) Science 259:1745-8). The use of cationic lipids may promote encapsulation of negatively charged nucleic acids, and also promote fusion with negatively charged cell membranes (Felgner and Ringold, (1989) Nature 337:387-8). Particularly useful lipid compounds and compositions for transfer of nucleic acids are described in International Patent Publications WO 95/18863 and WO 96/17823, and in U.S. Pat. No. 5,459,127. The use of lipofection to introduce exogenous genes into the specific organs in vivo has certain practical advantages and directing transfection to particular cell types would be particularly advantageous in a tissue with cellular heterogeneity, for example, pancreas, liver, kidney, and the brain. Lipids may be chemically coupled to other molecules for the purpose of targeting. Targeted peptides, e.g., hormones or neurotransmitters, and proteins for example, antibodies, or non-peptide molecules could be coupled to liposomes chemically. Other molecules are also useful for facilitating transfection of a nucleic acid in vivo, for example, a cationic oligopeptide (e.g., International Patent Publication WO 95/21931), peptides derived from DNA binding proteins (e.g., International Patent Publication WO 96/25508), or a cationic polymer (e.g., International Patent Publication WO 95/21931).

It is also possible to introduce a DNA vector in vivo as a naked DNA plasmid (see U.S. Pat. Nos. 5,693,622, 5,589,466 and 5,580,859). Naked DNA vectors for therapeutic purposes can be introduced into the desired host cells by methods known in the art, e.g., transfection, electroporation, microinjection, transduction, cell fusion, DEAE dextran, calcium phosphate precipitation, use of a gene gun, or use of a DNA vector transporter (see, e.g., Wilson, et al. (1992) J. Biol. Chem. 267:963-7; Wu and Wu, (1988) J. Biol. Chem. 263: 14621-4; Hartmut, et al. Canadian Patent Application No. 2,012,311, filed Mar. 15, 1990; Williams, et al (1991). Proc. Natl. Acad. Sci. USA 88:2726-30). Receptor-mediated DNA delivery approaches can also be used (Curiel, et al. (1992) Hum. Gene Ther. 3:147-54; Wu and Wu, (1987) J. Biol. Chem. 262:4429-32).

The present invention also provides biologically compatible, bone formation-enhancing compositions comprising an effective amount of one or more compounds identified as TARGET inhibitors, and/or the expression-inhibiting agents as described hereinabove.

A biologically compatible composition is a composition, that may be solid, liquid, gel, or other form, in which the compound, polynucleotide, vector, and antibody of the invention is maintained in an active form, e.g., in a form able to effect a biological activity. For example, a compound of the invention would have inverse agonist or antagonist activity on the TARGET; a nucleic acid would be able to replicate, translate a message, or hybridize to a complementary mRNA of a TARGET; a vector would be able to transfect a TARGET cell and expression the antisense, antibody, ribozyme or siRNA as described hereinabove; an antibody would bind a TARGET polypeptide domain.

A preferred biologically compatible composition is an aqueous solution that is buffered using, e.g., Tris, phosphate, or HEPES buffer, containing salt ions. Usually the concentration of salt ions will be similar to physiological levels. Biologically compatible solutions may include stabilizing agents and preservatives. In a more preferred embodiment, the biocompatible composition is a pharmaceutically acceptable composition. Such compositions can be formulated for administration by topical, oral, parenteral, intranasal, subcutaneous, and intraocular, routes. Parenteral administration is meant to include intravenous injection, intramuscular injection, intraarterial injection or infusion techniques. The composition may be administered parenterally in dosage unit formulations containing standard, well-known non-toxic physiologically acceptable carriers, adjuvants and vehicles as desired.

A particularly preferred embodiment of the present composition invention is a bone formation-enhancing pharmaceutical composition comprising a therapeutically effective amount of an expression-inhibiting agent as described hereinabove, in admixture with a pharmaceutically acceptable carrier. Another preferred embodiment is a pharmaceutical composition for the treatment or prevention of a condition a systemic or local decrease in mean bone density, or a susceptibility to the condition, comprising an effective bone formation-enhancing amount of a TARGET antagonist or inverse agonist, its pharmaceutically acceptable salts, hydrates, solvates, or prodrugs thereof in admixture with a pharmaceutically acceptable carrier.

Pharmaceutical compositions for oral administration can be formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions, and the like, for ingestion by the patient. Pharmaceutical compositions for oral use can be prepared by combining active compounds with solid excipient, optionally grinding a resulting mixture, and processing the mixture of granules, after adding suitable auxiliaries, if desired, to obtain tablets or dragee cores. Suitable excipients are carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, or sodium carboxymethyl-cellulose; gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate. Dragee cores may be used in conjunction with suitable coatings, such as concentrated sugar solutions, which may also contain gum arabic, talc, polyvinyl-pyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical preparations that can be used orally include push-fit capsules made of gelatin, as well as soft, sealed capsules made of gelatin and a coating, such as glycerol or sorbitol. Push-fit capsules can contain active ingredients mixed with filler or binders, such as lactose or starches, lubricants, such as talc or magnesium stearate, and, optionally, stabilizers. In soft capsules, the active compounds may be dissolved or suspended in suitable liquids, such as fatty oils, liquid, or liquid polyethylene glycol with or without stabilizers.

Preferred sterile injectable preparations can be a solution or suspension in a non-toxic parenterally acceptable solvent or diluent. Examples of pharmaceutically acceptable carriers are saline, buffered saline, isotonic saline (e.g. monosodium or disodium phosphate, sodium, potassium; calcium or magnesium chloride, or mixtures of such salts), Ringer's solution, dextrose, water, sterile water, glycerol, ethanol, and combinations thereof 1,3-butanediol and sterile fixed oils are conveniently employed as solvents or suspending media. Any bland fixed oil can be employed including synthetic mono- or di-glycerides. Fatty acids such as oleic acid also find use in the preparation of injectables.

The composition medium can also be a hydrogel, which is prepared from any biocompatible or non-cytotoxic homo- or hetero-polymer, such as a hydrophilic polyacrylic acid polymer that can act as a drug absorbing sponge. Certain of them, such as, in particular, those obtained from ethylene and/or propylene oxide are commercially available. A hydrogel can be deposited directly onto the surface of the tissue to be treated, for example during surgical intervention.

Embodiments of pharmaceutical compositions of the present invention comprise a replication defective recombinant viral vector encoding the polynucleotide inhibitory agent of the present invention and a transfection enhancer, such as poloxamer. An example of a poloxamer is Poloxamer 407, which is commercially available (BASF, Parsippany, N.J.) and is a non-toxic, biocompatible polyol. A poloxamer impregnated with recombinant viruses may be deposited directly on the surface of the tissue to be treated, for example during a surgical intervention. Poloxamer possesses essentially the same advantages as hydrogel while having a lower viscosity.

The active expression-inhibiting agents may also be entrapped in microcapsules prepared, for example, by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences (1980) 16th edition, Osol, A. Ed.

Sustained-release preparations may be prepared. Suitable examples of sustained-release preparations include semi-permeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and gamma-ethyl-L-glutamate, non-degradable ethylene-vinyl acetate, degradable lactic acid-glycolic acid copolymers such as the LUPRON DEPOT™. (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S-S bond formation through thio-disulfide interchange, stabilization may be achieved by modifying sulfhydryl residues, lyophilizing from acidic solutions, controlling moisture content, using appropriate additives, and developing specific polymer matrix compositions.

As defined above, therapeutically effective dose means that amount of protein, polynucleotide, peptide, or its antibodies, agonists or antagonists, which ameliorate the symptoms or condition. Therapeutic efficacy and toxicity of such compounds can be determined by standard pharmaceutical procedures in cell cultures or experimental animals, e.g., ED50 (the dose therapeutically effective in 50% of the population) and LD50 (the dose lethal to 50% of the population). The dose ratio of toxic to therapeutic effects is the therapeutic index, and it can be expressed as the ratio, LD50/ED50. Pharmaceutical compositions that exhibit large therapeutic indices are preferred. The data obtained from cell culture assays and animal studies is used in formulating a range of dosage for human use. The dosage of such compounds lies preferably within a range of circulating concentrations that include the ED50 with little or no toxicity. The dosage varies within this range depending upon the dosage form employed, sensitivity of the patient, and the route of administration.

For any compound, the therapeutically effective dose can be estimated initially either in cell culture assays or in animal models, usually mice, rabbits, dogs, or pigs. The animal model is also used to achieve a desirable concentration range and route of administration. Such information can then be used to determine useful doses and routes for administration in humans. The exact dosage is chosen by the individual physician in view of the patient to be treated. Dosage and administration are adjusted to provide sufficient levels of the active moiety or to maintain the desired effect. Additional factors which may be taken into account include the severity of the disease state, age, weight and gender of the patient; diet, desired duration of treatment, method of administration, time and frequency of administration, drug combination(s), reaction sensitivities, and tolerance/response to therapy. Long acting pharmaceutical compositions might be administered every 3 to 4 days, every week, or once every two weeks depending on half-life and clearance rate of the particular formulation.

The pharmaceutical compositions according to this invention may be administered to a subject by a variety of methods. They may be added directly to TARGET tissues, complexed with cationic lipids, packaged within liposomes, or delivered to TARGET cells by other methods known in the art. Localized administration to the desired tissues may be done by direct injection, transdermal absorption, catheter, infusion pump or stent. The DNA, DNA/vehicle complexes, or the recombinant virus particles are locally administered to the site of treatment. Alternative routes of delivery include, but are not limited to, intravenous injection, intramuscular injection, subcutaneous injection, aerosol inhalation, oral (tablet or pill form), topical, systemic, ocular, intraperitoneal and/or intrathecal delivery. Examples of ribozyme delivery and administration are provided in Sullivan et al. WO 94/02595.

Antibodies according to the invention may be delivered as a bolus only, infused over time or both administered as a bolus and infused over time. Those skilled in the art may employ different formulations for polynucleotides than for proteins. Similarly, delivery of polynucleotides or polypeptides will be specific to particular cells, conditions, locations, etc.

As discussed hereinabove, recombinant viruses may be used to introduce DNA encoding polynucleotide agents useful in the present invention. Recombinant viruses according to the invention are generally formulated and administered in the form of doses of between about $10^4$ and about $10^{14}$ pfu. In the case of AAVs and adenoviruses, doses of from about $10^6$ to about $10^{11}$ pfu are preferably used. The term pfu ("plaque-forming unit") corresponds to the infective power of a suspension of virions and is determined by infecting an appropriate cell culture and measuring the number of plaques formed. The techniques for determining the pfu titre of a viral solution are well documented in the prior art.

The present invention also provides methods of enhancing bone formation, which comprise the administration to said subject a therapeutically effective amount of an expression-inhibiting agent of the invention. A further aspect of the invention relates to a method of treating or preventing a disease involving a systemic or local decrease in mean bone density, comprising administering to said subject a bone formation enhancing pharmaceutical composition as described herein.

The invention also relates to the use of an agent as described above for the preparation of a medicament for treating or preventing a disease involving a systemic or local descrease in mean bone density.

In a preferred embodiment of the present invention the disease is selected from the group consisting of osteoporosis, hypercalcemia of malignancy, multiple myelomatosis, hyperparathyroidism, and hyperthyroidism. A special embodiment of this invention is a method wherein the disease is osteoporosis.

Still another aspect of the invention relates to a method for diagnosing a pathological condition involving a systemic or local decrease in mean bone density or a susceptibility to the condition in a subject, comprising determining the amount of polypeptide comprising an amino acid sequence selected from the group consisting of SEQ ID NO: 377-418, 601, 867-1119, 1123-1133 in a biological sample, and comparing the amount with the amount of the polypeptide in a healthy subject, wherein an increase of the amount of polypeptide compared to the healthy subject is indicative of the presence of the pathological condition.

Preferably the pathological condition is selected from the group consisting of osteoporosis, hypercalcemia of malignancy, multiple myelomatosis, hyperparathyroidism, and hyperthyroidism. More preferably, the pathological condition is osteoporosis.

The polypeptides or the polynucleotides of the present invention employed in the methods described herein may be free in solution, affixed to a solid support, borne on a cell surface, or located intracellularly. To perform the methods it is feasible to immobilize either the polypeptide of the present invention or the compound to facilitate separation of complexes from uncomplexed forms of the polypeptide, as well as to accommodate automation of the assay. Interaction (e.g., binding of) of the polypeptide of the present invention with a compound can be accomplished in any vessel suitable for containing the reactants. Examples of such vessels include microtitre plates, test tubes, and microcentrifuge tubes. In one embodiment, a fusion protein can be provided which adds a domain that allows the polypeptide to be bound to a matrix. For example, the polypeptide of the present invention can be "His" tagged, and subsequently adsorbed onto Ni-NTA microtitre plates, or ProtA fusions with the polypeptides of the present invention can be adsorbed to IgG, which are then combined with the cell lysates (e.g., $(35)^S$-labelled) and the candidate compound, and the mixture incubated under conditions favorable for complex formation (e.g., at physiological conditions for salt and pH). Following incubation, the plates are washed to remove any unbound label, and the matrix is immobilized. The amount of radioactivity can be determined directly, or in the supernatant after dissociation of the complexes. Alternatively, the complexes can be dissociated from the matrix, separated by SDS-PAGE, and the level of the protein binding to the protein of the present invention quantitated from the gel using standard electrophoretic techniques.

Other techniques for immobilizing protein on matrices can also be used in the method of identifying compounds. For example, either the polypeptide of the present invention or the compound can be immobilized utilizing conjugation of biotin and streptavidin. Biotinylated protein molecules of the present invention can be prepared from biotin-NHS (N-hydroxy-succinimide) using techniques well known in the art (e.g., biotinylation kit, Pierce Chemicals, Rockford, Ill.), and immobilized in the wells of streptavidin-coated 96 well plates (Pierce Chemical). Alternatively, antibodies reactive with the polypeptides of the present invention but which do not interfere with binding of the polypeptide to the compound can be derivatized to the wells of the plate, and the polypeptide of the present invention can be trapped in the wells by antibody conjugation. As described above, preparations of a labeled candidate compound are incubated in the wells of the plate presenting the polypeptide of the present invention, and the amount of complex trapped in the well can be quantitated.

The polynucleotides of the invention, complementary to SEQ ID NO: 1-220, 247-333 increase osteoblast differentiation.

Accordingly, another embodiment of the present invention relates to a method for in vitro production of bone tissue, comprising the steps of contacting undifferentiated mammalian cells with a polynucleotide sequence comprising a sequence selected from the group consisting of sequences complementary to SEQ ID No: 335-376, 600, 607-866, 1120-1122, preferably selected from the group consisting of sequences complementary to SEQ ID NO: 1-220, 247-333 for a time sufficient to differentiate the undifferentiated cells into osteoblasts, thereby producing a continuous bone matrix.

In a preferred embodiment, the method comprises the steps of:
(a) applying undifferentiated mammalian cells on a substrate to form a cellular substrate,
(b) introducing a polynucleotide comprising a nucleotide sequence selected from the group consisting of sequences complementary to SEQ ID No: 335-376, 600, 607-866, 1120-1122, preferably selected from the group consisting of sequences complementary to SEQ ID NO: 1-220, 247-333, for a time sufficient to differentiate the undifferentiated cells into osteoblasts, thereby producing a continuous bone matrix.

The invention thus provides a method for producing a substrate with a matrix grown thereon, which matrix may be used for the provision of load-bearing implants, including joint prostheses, such as artificial hip joints, knee joints and finger joints, and maxillofacial implants, such as dental implants. It can also be used for special surgery devices, such as spacers, or bone fillers, and for use in augmentation, obliteration or reconstitution of bone defects and damaged or lost bone. Bone formation can be optimized by variation in mineralization, both by inductive and by conductive processes.

The present invention also relates to a combination of a load-bearing implant (preferably coated with a matrix as described above) with a bone filler comprising a matrix as described.

The method of the invention is also very suitable in relation to revision surgery, i.e., when previous surgical devices require replacement.

Suitable undifferentiated cells are bone marrow cells, including haematopoietic cells and in particular stromal cells. The marrow cells, and especially the stromal cells are found to be very effective in the bone producing process when taken from their original environment.

The undifferentiated cells can be directly applied on the substrate or they can advantageously be multiplied in the absence of the substrate before being applied on the substrate. In the latter mode, the cells are still largely undifferentiated after multiplication and, for the purpose of the invention, they are still referred to as undifferentiated. Subsequently, the cells are allowed to differentiate. Differentiation can be induced or enhanced by the presence of suitable inductors, such as glucocorticoids, and dexamethasone. Suitable inductors of differentiation are the expression inhibitory agents of the present invention.

The use of undifferentiated cells provides several advantages. Firstly, their lower differentiation implies a higher proliferation rate and allows the eventual functionality to be better directed and controlled. Moreover, culturing these cells not only produces the required bone matrix containing organic and inorganic components, but also results in the presence, in the culture medium and in the matrix, of several factors which are essential for growth of the tissue and for adaptation to existing living tissue. Also, the culture medium can be a source of active factors such as growth factors, to be used in connection with the implanting process. Furthermore, such undifferentiated cells are often available in large quantities and more conveniently than e.g., mature bone cells, and exhibit a lower morbidity during recovery. Moreover, the undifferentiated cells can be obtained from the patient for whom the implant is intended. The bone resulting from these cells is autologous to the patient and thus no immune response will be induced. Matrices as thick as 100 μm can be produced as a result of the use of undifferentiated cells.

The substrate on which the undifferentiated cells can be applied and cultured can be a metal, such as titanium, cobalt/chromium alloy or stainless steel, a bioactive surface such as a calcium phosphate, polymer surfaces such as polyethylene, and the like. Although less preferred, siliceous material such as glass ceramics, can also be used as a substrate. Most preferred are metals, such as titanium, and calcium phosphates, even though calcium phosphate is not an indispensable component of the substrate. The substrate may be porous or non-porous. The cells can be applied at a rate of e.g., $10^3$-$10^6$ per cm$^2$, in particular $10^4$-$2\times10^5$ cells per cm$^2$.

The culture medium to be used in the method according to the invention can be a commonly known culture medium such as MEM (minimum essential medium). Advantageously, the medium can be a conditioned medium. In this context, a conditioned medium is understood to be a medium wherein similar cells have previously been incubated, causing the medium to contain factors such as polypeptides, secreted by the cells which are important for cell growth and cell differentiation.

The cells are cultured for a time sufficient to produce a matrix layer, e.g., a matrix layer having a thickness of at least 0.5 μm, in particular from 1 up to 100 μm, more in particular of 10-50 μm. The cells may be contacted with the culture medium for e.g. 2-15 weeks, in particular 4-10 weeks.

The production of the matrix, when applied on a substrate, results in a continuous or quasi-continuous coating covering the substrate for at least 50%, in particular at least 80% of its surface area.

The present invention further relates to the osteoblast cells obtainable by the above method.

Still another aspect or the invention relates to a method for diagnosing a pathological condition involving cognitive impairment or a susceptibility to the condition in a subject, comprising determining the amount of polypeptide comprising an amino acid sequence selected from the group consisting of SEQ ID NO: 377-418, 601, 867-1119, 1123-1133 in a biological sample, and comparing the amount with the amount of the polypeptide in a healthy subject, wherein an increase of the amount of polypeptide compared to the healthy subject is indicative of the presence of the pathological condition.

The invention is further illustrated in the following figures and examples.

Experimental Section

EXAMPLE 1

Development of a High-Throughput Screening Method for the Detection of Endogenous Alkaline Phosphatase Adenoviral Controls.

Ad-BMP2: described in WO 03/018799

Ad-eGFP: Referred to as pIPspAdApt6-EGFP in WO 02070744

Ad-hCAR: hCAR cDNA is isolated using a PCR methodology. The hCAR cDNA is PCR amplified from a HeLa cell cDNA library (Quick clone, Clontech). A single fragment of 1119 bp is obtained and digested with the HindIII and BamHI restriction enzymes. pIPspAdapt6 vector (WO99/64582) is digested with the same enzymes, gel-purified and used to ligate to the digested PCR hCAR fragment. AdC15 (Ad5/Ad35) and AdC20 (Ad5/Ad51) viruses are generated as described in WO02/24933

Ad5-luc_v13: Cloned by PCR and virus generated as described in WO 03020931

Ad5-M6PR_v1: Cloned using Sap1-sites into vector and virus generated as described in WO03/020931.

H9: Cloned using Sap1-sites into vector and virus generated as described in WO03/020931

H11: Cloned using Sap1-sites into vector and virus generated as described in WO03/020931

Principle of the Assay

Figure 2:
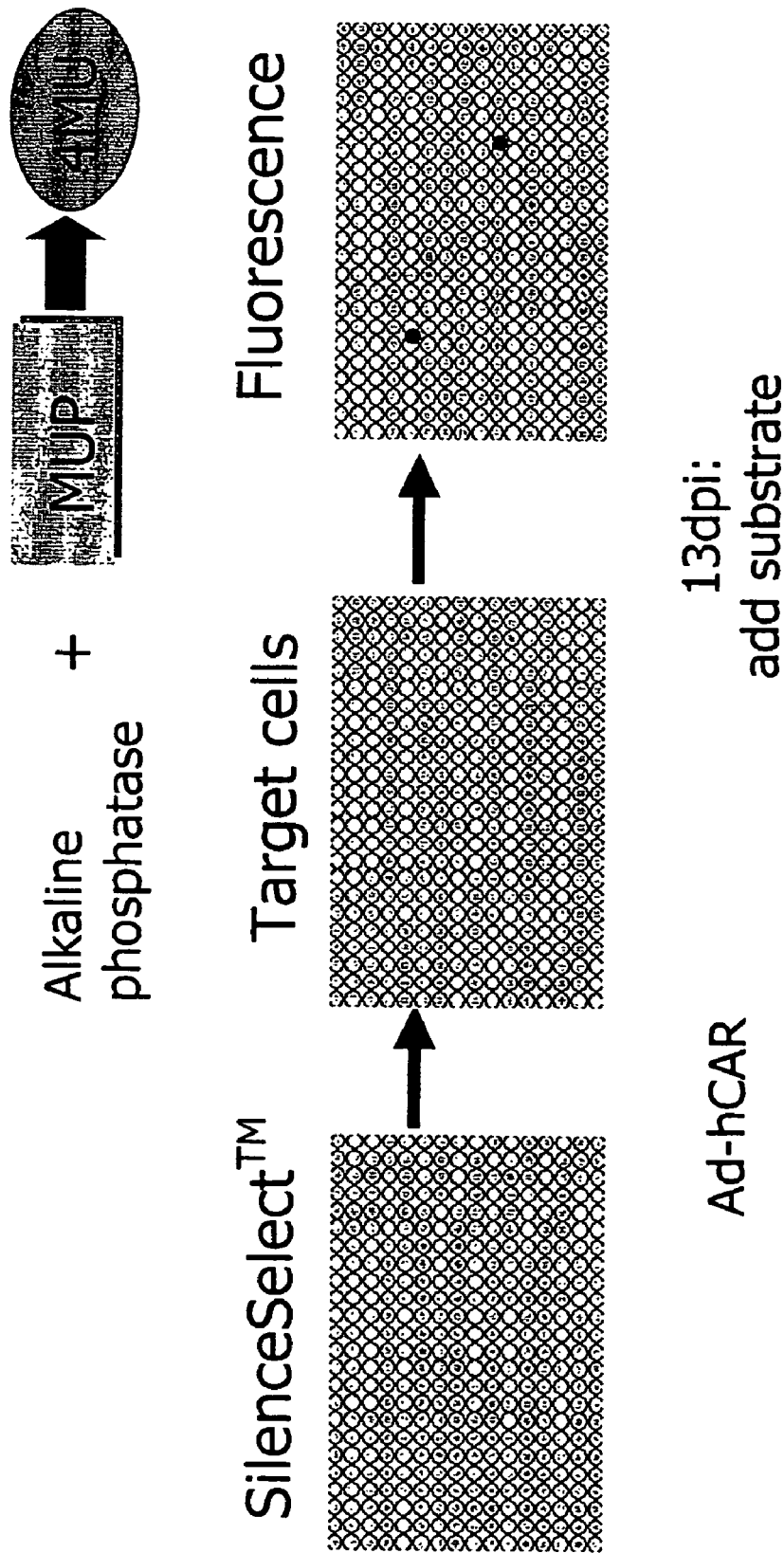
FIG. 2. Principle of the osteoblast differentiation assay.

Mesenchymal progenitor cells (MPCs) differentiate into osteoblasts in the presence of appropriate factors (e.g. BMP2). An assay to screen for such factors is developed by monitoring the activity of alkaline phosphatase (AP) enzyme, an early marker in the osteoblast differentiation program. MPCs are seeded in 384 well plates and simultaneously co-infected one day later with adenoviruses encoding the human coxsackie and adenovirus receptor (hCAR; Ad-hCAR) and individual siRNA adenoviruses (Ad-siRNA) from the SILENCESELCET® collection. AdC15-hCAR/ AdC20-hCAR co-infection increases the AdC01-siRNA infection efficiency. Cellular AP activity is determined 13 days after the start of the infection (13 dpi). (FIG. 2 illustrates the principle of the assay).

Development of the Assay

MPCs are isolated from the bone marrow of healthy volunteers, obtained after informed consent (Cambrex/Biowhittaker, Verviers, Belgium).

In a series of experiments, carried out in 384 well plates, several parameters are optimized: cell seeding density, multiplicities of infection (MOI) of control viruses (Ad-BMP2 or Ad-eGFP), MOI of Ad-hCAR, duration of infection, toxicity, infection efficiency (using Ad-eGFP) and the day of readout.

Using Ad-BMP2 (BMP2 overexpression) as a positive control for assay development, the following protocol results in the highest dynamic range for the assay with the lowest standard deviation on the background signal:

MPCs are seeded on day 0 at 500 cells per well of a 384 well plate and co-infected the next day using a mix of Ad-hCAR (5 μl of an Ad-hCAR solution: mix total MOI=155.7) and 1 μl of Ad-control-virus (Ad-BMP2 or Ad-eGFP; corresponds to a theoretical MOI of 5000). On day 5, the medium containing the virus is removed and replaced by fresh medium containing no virus. Up-regulation of alkaline phosphatase is read at 13 dpi (days post infection): 15 μl 4-Methylumbelliferylphosphate (MUP, Sigma) is added to each well, the plates are incubated for 15 min at 37° C. and monitored for AP activity using a fluorescence plate reader (Fluostar, BMG).

After optimisation of the assay, a small pilot screen is run (103 different Ad-siRNA viruses) with the use of robotics (96/384 channel dispensor Tecan Freedom 200 equipped with TeMO96, TeMO384 and RoMa, Tecan AG, Switzerland). The TARGETS from this screen are collected and retested in the same assay. The two Ad-siRNAs that score strongest (H9=H24-010; H10=H24-011) are used to generate a control plate (knock-down (KD) control plate) containing Ad-siRNAs. The control plate, a 96 well plate containing 3 negative (N1,N2,N3) and 3 positive (P1,P2,P3) control viruses is depicted in FIG. 3. This "knock-down" control plate contains Ad-H9 (H24-010) and Ad-H 10 (H24-011) as positive controls; Ad-eGFP (knock-in virus) as infection control; and Ad-eGFP-siRNA, Ad-M6PR-siRNA and Ad-Luc-siRNA (all 3 are knock-down viruses) as negative controls.

The control viruses are pipetted from 96 well KD control plates into 384 well plates using robotics. (The final lay-out of the 384 well plate is depicted in FIG. 4).

Figure 5:
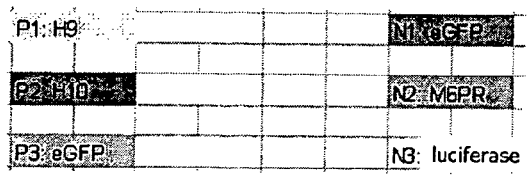
FIG. 5. Performance of the knock-down control plate in the AP assay
FIG. 6. Dot plot representation of raw data for one SILENCESELECT® screening plate
FIG. 7. Profiling of target expression in MPCs (A) and knock-down of gene expression by Ad-siRNA (B)
FIG. 8. Profiling of target expression in primary human OBs
FIG. 9. Analyzing the upregulation of BAP-mRNA versus PLAP- or IAP-mRNA
FIG. 10. Results mineralization assay
FIG. 11. Pipetting scheme used for screening the Ad-shRNAs at 3 MOIs.

FIG. 5 shows the results of the automated screening procedure using the KD control plate. The mean and standard deviations of the KD negative controls (N1-N3) are used to calculate a cut-off for TARGET analysis, which is set at the mean for N1, N2, N3 ('All negatives') plus 3 times the standard deviation for 'All negatives'. The positive controls (P1 and P2), scored in more than 95% of the infected wells. The negative control viruses scored in less than 5% of the wells.

EXAMPLE 2

Screening of 7980 Ad-siRNA Adenoviruses in the Osteogenesis Assay

Figure 6:
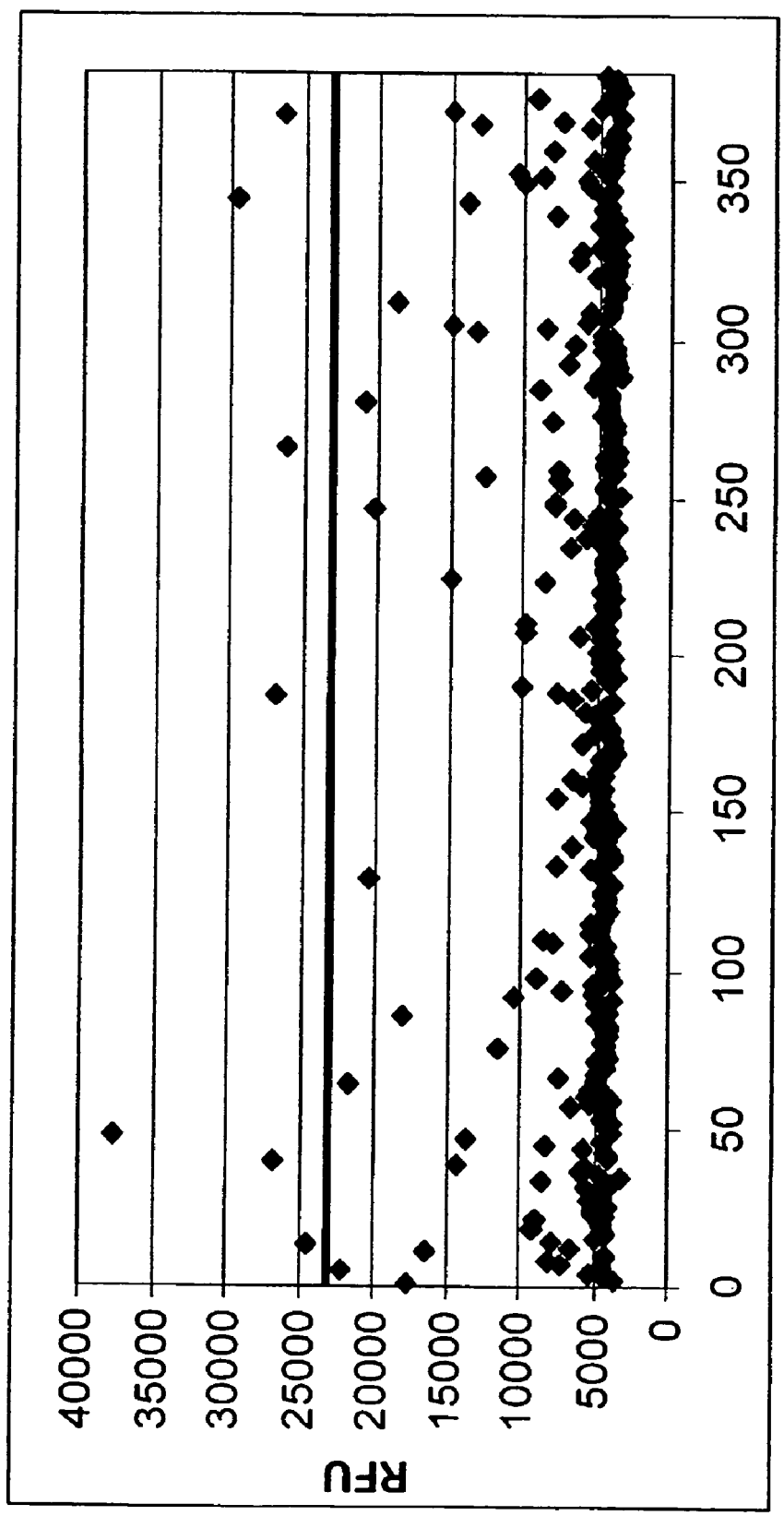

The optimized protocol for screening the SILENCESELECT® library is the following: on day 0, MPC cells are seeded in black 384 well plates with clear bottom (Costar or Nunc) in 60 μl medium at a density of 500 cells per well. One day later, 1 μl Ad-siRNA virus from the SILENCESELECT® collection, stored in 384 well plates (estimated titer of 2.5× $10^9$ viral particles per ml) and 5 μl of Ad-hCAR solution (total MOI=155), dispensed in 96 well V-bottom plates, is transferred with the aid of a 96/384 channel dispenser (Tecan Freedom 200 equipped with TeMO96, TeMO384 and RbMa, Tecan AG, Switzerland) from the wells of a 96 well plate containing the Ad-hCAR solution to each of the wells of the 384 well plates containing MPCs. The KD control plate is run under the same conditions as the aliquot plates from the SILENCESELEST® collection. All Ad-siRNA viruses are screened in duplicate, with each singular on a different MPC plate. Plates are then incubated at 37° C. Four days post infection the medium containing the adenoviruses is replaced by fresh medium free of virus. Thirteen days post infection, the AP activity readout is performed. A typical result of a 384 well screening plate is depicted in FIG. 6, in which the relative fluorescence units (RFU) are plotted for each of the data points of the 384 well plate on the Y-axis; while the numbers on the X-axis correspond to positions in the 384 well plate.

This duplicate screen is done twice, and all four data points are used for TARGET identification (see Example 3).

EXAMPLE 3

Target Identification Using the AP Assay

The data obtained from measuring the AP activity in Examples 1 and 2 are analyzed as follows: the background is calculated by taking the mean of the data points from all the plates except the control plate. A cut-off value for TARGET identification is calculated by adding 3 times the standard deviation of all data points, excluding the control plate. Each data point is analyzed for scoring above or under the cut-off. Only Ad-siRNAs inducing endogenous AP activity levels above the cut-off are of further interest. TARGETS are prioritized according to their scoring in single or duplicate, in one or both of the screens. Data are collected for 7980 Ad-siRNA virus constructs representing 4091 independent genes. An overview of the constructs is given in Table 1.

One of the identified hits has been shown to be a bone anabolic factor before and therefore validates the assay:

H24-034: SRC

Marzia et al. (2000) showed that bone formation was increased in Src null mice compared to wild-type mice. Most relevant to this work, osteoblasts isolated from Src null mice or osteoblasts isolated from wild-type mice but transfected with Src-antisense oligonucleotides showed increased AP activity in vitro.

8 genes identified in the screen were targeted by 2 Ad-siRNAs. These genes are AVPR1B, FLJ22955, IL1F8, PPIA, USP38, C9, LOC254378 and BRS3 (see Table 1).

The siRNA sequences of the present invention comprise sequences complementary to sequences corresponding to the identified KD TARGETS (SEQ ID NO: 1-220, 247-333). For the preferred TARGETS, the corresponding polynucleotides known in public databases (referred to as SEQ ID NO: 335-376, 600, 607-866, 1120-1122), their respective names and the polypeptides translated from those polynucleotides (referred to as SEQ ID NO: 377-418, 601, 867-1119, 1123-1133), are listed in Table 1.

EXAMPLE 4

Quality Control of the Target Ad-siRNAs

The Ad-siRNA TARGETS are subjected to further analysis to establish their therapeutic application as bone anabolic factors. The Ad-siRNA is subjected to quality control analysis (this example). Other validation steps are the validation of the TARGETS at the mRNA level (Example 5), screening of the targets in osteogenesis assays such as the mineralization assay (Example 6), and development of additional Ad-siRNAs targeting the identified genes (Example 9). TARGETS that remain of interest after these validation assays are considered for drug discovery and assays are developed allowing the discovery and optimization of compounds that mimick the bone anabolic actions of the target Ad-siRNAs (Example 7). In addition, the anti-resorptive activities of the identified Ad-siRNAs are validated in osteoclast assays (Example 8).

Verifying the Identity of the siRNA Insert from the TARGET Ad-siRNAs

TARGET Ad-siRNAs are propagated using PERC6/E2A cells (see WO99/64582) seeded in a 96-well plate, followed by re-screening of these viruses at several MOI's in the primary assay (see Example 1) and by sequencing the siRNAs encoded by the TARGET Ad-siRNA viruses. This procedure is carried out as follows.

PERC6/E2A cells are seeded in 96-well plates at a density of 40,000 cells/well in 180 μl PERC6/E2A medium. Cells are then incubated overnight at 39° C. in a 10% $CO_2$ humidified incubator. One day later, cells are infected with 1 μl of crude cell lysate from SILENCESELECT® stocks containing TARGET Ad-siRNAs. Cells are further incubated at 34° C., 10% $CO_2$ until appearance of cytopathic effect (cpe, as revealed by the swelling and rounding up of the cells which typically occurs 7 days post infection). The supernatant is collected and the virus crude lysate is treated with proteinase K: 12 μl crude lysate is added to 4 μl Lysis buffer (1× Expand High Fidelity buffer with $MgCl_2$ (Roche Molecular Biochemicals, Cat. No 1332465) supplemented with 1 mg/ml proteinase K (Roche Molecular Biochemicals, Cat No 745 723) and 0.45% Tween-20 (Roche Molecular Biochemicals, Cat No 1335465) in sterile PCR tubes. These are incubated at 55° C. for 2 h followed by a 15 min inactivation step at 95° C. For the PCR reaction, 1 μl lysate is added to a PCR master mix composed of 5 μl 10× Expand High Fidelity buffer with $MgCl_2$, 0.5 μl of dNTP mix (10 mM for each dNTP), 1 μl of 'Forward primer' (10 mM stock, sequence: 5' CCG TTT ACG TGG AGA CTC GCC, SEQ ID NO: 245) and 1 μl 'Reverse Primer' (10 mM stock, sequence: 5' CCC CCA CCT TAT ATA TAT TCT TTC C, SEQ ID NO: 246), 0.2 μl of Expand High Fidelity DNA polymerase (3.5 U/μl, Roche Molecular Biochemicals) and 41.3 μl H₂O. PCR is performed in a PE Biosystems GeneAmp PCR system 9700 as follows: the PCR mixture (50 μl in total) is incubated at 95° C. for 5 min; each cycle runs at 95° C. for 15 sec, 55° C. for 30 sec, 68° C. for 4 min, and is repeated for 35 cycles. A final incubation at 68° C. is performed for 7 min. 5 μl of the PCR mixture is mixed with 2 μl of 6× gel loading buffer, loaded on a 0.8% agarose gel containing 0.5 μg/μl ethidium bromide to resolve the amplification products. The size of the amplified fragments is estimated from a standard DNA ladder loaded on the same gel. The expected size is ~500 bp.

For sequencing analysis, the siRNA constructs expressed by the TARGET adenoviruses are amplified by PCR using primers complementary to vector sequences flanking the SapI site of the pIPspAdapt6-U6 plasmid. The sequences of the PCR fragments are determined and compared with the expected sequence.

For the KD TARGET sequences identified (Table 1), sequence analysis confirmed that the siRNA present in the TARGET Ad-siRNA had the expected sequence.

Multiple MOI Rescreen

The propagated TARGET Ad-siRNAs were rescreened at several MOIs in the AP assay (Example 1). The Ad-siRNAs had to score in duplo at at least one MOI to pass this quality control step.

All TARGETS listed in Table 1 fulfilled this quality control step and thus:
a) showed the correct length of the PCR fragment
b) showed the correct sequence of the PCR fragment
c) induced AP activity in duplicate for at least 1 MOI.

EXAMPLE 5 mRNA Validation Experiments for Identified Targets

A validation of the target Ad-siRNAs is carried out on RNA isolated from infected MPCs. First, the expression of the targets is analyzed in several isolates of primary human MPCs and osteoblasts (hOBs). Second, the knock-down of the target gene expression by the Ad-siRNA is verified at the mRNA level. Third, the upregulation of endogenous bone AP mRNA versus that of placental or intestinal AP mRNA is analyzed.

MPC and Osteoblast Expression Analysis for the Identified Targets Profiling

Expression levels of target genes are determined in 4 different isolates of MPCs and 2 different isolates of hOBs. The MPCs and hOBs (obtained from Cambrex/Biowhittaker, Verviers, Belgium) are seeded at 3000 resp. 5000 cells/cm² in T180 flasks and cultured until they reach 80% confluency. The cells are washed with ice-cold PBS and harvested by adding 1050 μl SV RNA Lysis Buffer to a T180 flask. Total RNA is prepared using the SV Total RNA isolation System (Promega, Cat #Z3100). The concentration of the total RNA is measured with the Ribogreen RNA Quantification kit (Molecular Probes, Leiden, The Netherlands, Cat No. R-11490). cDNA synthesis is performed using 40 ng total RNA per reaction using the TaqMan Universal PCR Master Mix, No AmpErase UNG, kit (Applied Biosystems, Warrington, UK, Part number 4324018). For each RT reaction a minus-RT reaction (negative control: no enzyme included in the reaction) is performed.

Figure 8:
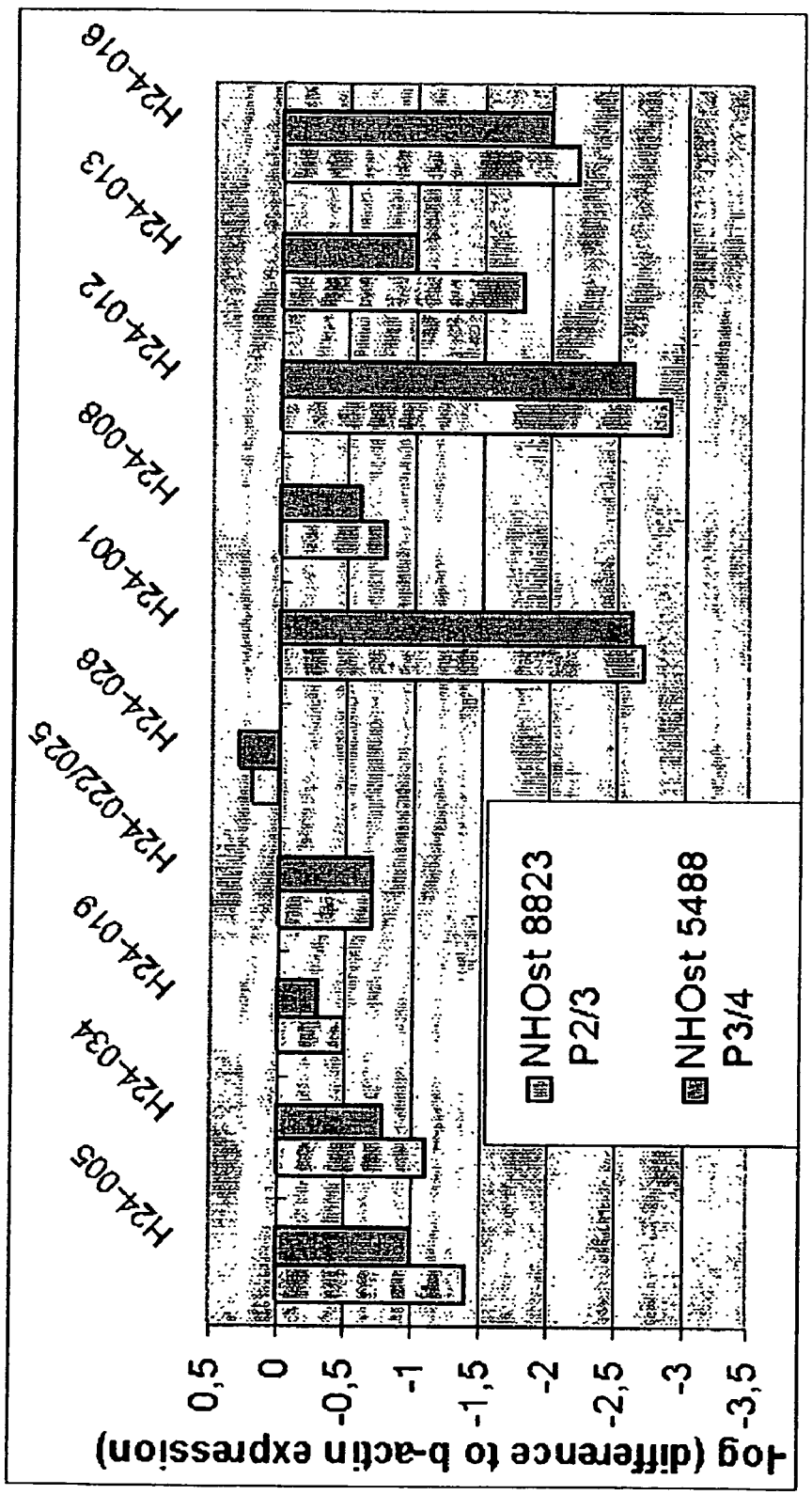
Figure 9:
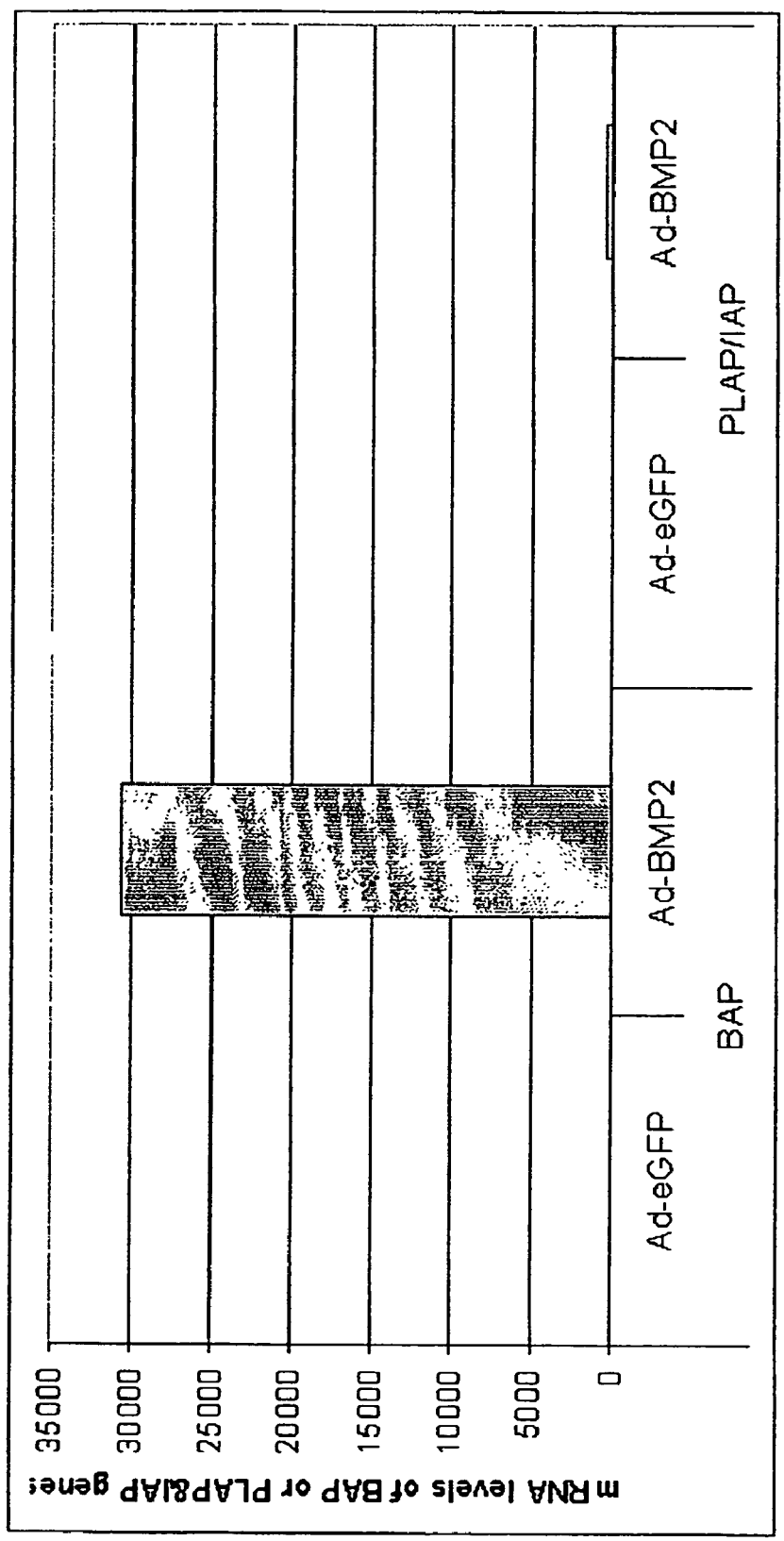

The real-time reverse transcriptase (rtRT)-PCR reaction is performed with gene specific primers on both cDNA and minus-RT samples, using the SYBR Green PCR Master Mix (Applied Biosystems, Warrington, UK, Part number 4309155). For the normalization of the expression levels, a RT-PCR reaction is performed on human β-actin using the Human β-actin kit (Applied Biosystems, Warrington, UK, Part number 4310881E). The following program is run on a real-time PCR apparatus (ABI PRISM 7000 Sequence Detection System): 10 min at 25° C., 30 min at 48° C., 5 min at 95° C. In FIGS. 7A and 8, relative expression levels for 10 genes are depicted for respectively MPC and hOB isolates. For the data in FIG. 7A, total RNA is extracted from 4 different MPC isolates and used to analyze expression levels of target genes identified through the target Ad-siRNAs. RtRT-PCR compatible primer sets (Table 4) are developed for 10 genes and compared to expression levels of β-actin. Data are expressed as −log(difference to β-actin) (Y-axis). For the data presented in FIG. 8, total RNA is extracted from 2 different hOB isolates.

TABLE 4

| Gene | Primer Name | Sequence | SEQ ID NO. |
|---|---|---|---|
| CALCRL | CALCRL_Rev | AGAGACCAAAAGACCCTGGAAGT | 222 |
| SRC | SRC_For | ACAGCGGCGGCTTCTACA | 223 |
| SRC | SRC_Rev | CATCGGCGTGTTTGGAGTAGT | 224 |
| PSMB3 | PSMB3_For | ATCCGGATCACCTGTTTGAAAC | 225 |
| PSMB3 | PSMB3_Rev | GTGGTGATTTTGTCCTTCTCGAT | 226 |
| HP43.8KD | HP43.8KD_For | CCATACACAGAGGGAAGCATACG | 227 |
| HP43.8KD | HP43.8KD_Rev | CAGTCTTGCTGTGATCTGGGAGTA | 228 |
| APEX | APEX_For | GCATAGGCGATGAGGAGCAT | 229 |
| APEX | APEX_Rev | GACCTCGGCCTGCATTAGG | 230 |
| GPR38 | GPR38_For | CATCGTCGCTCTGCAACTTTT | 231 |
| GPR38 | GPR38_Rev | CCGCTCTGTACTTCTTTGAAATGA | 232 |
| ROCK2 | ROCK2_For | CCTGGTGGAGACCTTGTAAACCT | 233 |
| ROCK2 | ROCK2_Rev | AGCAAGAACAACTTCAGCAGTGTAA | 234 |
| CXCR6 | CXCR6_For | GCCATGACCAGCTTTCACTACA | 235 |
| CXCR6 | CXCR6_Rev | GTTAAGGCAGGCCCTCAGGTA | 236 |
| OPN3 | OPN3_For | CTAACCGTGCTGGCCTATGAAC | 237 |
| OPN3 | OPN3_Rev | CAGGCCCAGGAAAAATTGATC | 238 |
| FUK | FUK_For | TTCGCGATCAGCCCCTTAC | 239 |
| FUK | FUK_Rev | ACTCACTGGCTGAGGAGGTCAT | 240 |

Analysis of the Knock-down of the Target Gene Expression by the Ad-siRNA is Verified at the mRNA Level.

To determine whether the target Ad-siRNAs result in knock-down of expression from the corresponding gene, total RNA is harvested from Ad-siRNA infected MPCs and gene expression is analyzed using gene-specific primers.

MPCs are seeded at 25,000 cells per well of a 24 well plate. After 24 hours the cells are infected with knock-down hit viruses or negative control viruses Ad-gPPARg and Ad-GL2.2 that knock down the expression of respectively PPARγ (all four known splice variants) and luciferase, both of which are not related to osteogenesis. For Ad-siRNAs, cells are co-infected with Ad-hCAR and Ad-siRNA crude lysates (MOI Ad-hCAR: 750; 40, 10, 3.3 μL virus with average titer of 2.5×10E9 virus particles/ml). At 5 dpi the medium is refreshed and at 14 dpi the cell lysates are prepared. Cells are processed for mRNA analysis as described in the previous section. mRNA levels for a specific gene are normalized for β-actin levels and compared to levels measured for the negative control Ad-siRNAs. An example of these kind of analyses is provided in FIG. 7B. Data are normalized for β-actin expression levels and compared to endogenous gene expression for MPCs infected with negative control viruses (Y-axis: percent gene expression of endogenous gene; 100%=endogenous mRNA levels present in negative control sample).

Analysis of the Upregulation of Endogenous Bone AP mRNA Versus that of Placental or Intestinal AP mRNA.

BAP is the physiologically relevant AP involved in bone formation. In order to determine whether the measured AP activities are due to upregulation of BAP expression or of another AP gene product, mRNA levels for all AP genes are analysed for infected MPCs. mRNA levels are determined as described in the previous sections. The difference is in the primer set used (see Table 5): one set detects BAP ALPL (human alkaline phosphatase liver/bone/kidney) mRNA expression. Another set detects the expression of the 3 other AP genes (ALPI (human alkaline phosphatase intestinal), ALPP (human alkaline phosphatase placental (PLAP)), and ALPPL2 (human alkaline phosphatase placental-like)). ALPI, ALPP and ALPPL2 are highly similar at the nucleotide level and can therefore be amplified using one primer pair.

The primer pairs are first validated on RNA isolated from MPCs infected with Ad-eGFP and Ad-BMP2. FIG. 7 illustrates the strong upregulation of BAP mRNA by Ad-BMP2 and the absence of upregulation of expression of any of the other AP genes. MPCs are infected in 24 well plate format using Ad-eGFP (negative control) or the osteogenic Ad-BMP2. Cells are harvested and RNA is prepared and subjected to rtRT-PCR using primer sets amplifying BAP mRNA or mRNA from the other 3 AP genes (PLAP/IAP). Ad-BMP2 strongly upregulates BAP mRNA levels but not the mRNA levels of the other 3 AP genes.

Both primer sets are then used to measure mRNA levels for all AP genes in RNA isolated from Ad-siRNA infected MPCs.

TABLE 5

| Name | Sequence | SEQ ID NO: |
|---|---|---|
| JDO-05F (PLAP) | TTCCAGACCATTGGCTTGAGT | 241 |
| JDO-05bisR (PLAP/ALPI/ALPPL2) | ACTCCCACTGACTTTCCTGCT | 242 |

TABLE 5-continued

| Name | Sequence | SEQ ID NO: |
|---|---|---|
| JDO-21F (BAP) | CATGCTGAGTGACACAGACAAGAAG | 243 |
| JDO-21R (BAP) | TGGTAGTTGTTGTGAGCATAGTCCA | 244 |

EXAMPLE 6

Mineralization

The process of osteogenesis consists of several successive events. During the initial phases of osteogenesis, bone alkaline phosphatase (BAP) becomes upregulated. It is however equally important to look at specific events occurring in later stages of osteogenesis such as mineralization. During differentiation, cells deposit (hydroxy)apatite ($Ca^{2+}$-phosphate precipitate) on an extracellular matrix consisting mostly of collagen type I to form mineralized bone.

Assay Setup

In the bone cell mineralizing assay (BM assay), primary human MSCs are differentiated in vitro into mineralizing osteoblasts using BMP2 (recombinant or delivered by adenoviral transduction) as an osteogenic agent. Mineralization is then visualized by staining the MSCs with Alizarin Red, a dye with a high affinity for calcium (see FIG. 8).

Screening and TARGET Identification

The following optimized protocol is used for screening Ad-siRNA and Ad-cDNA TARGETS identified in the primary assay:

100,000 MPCs are seeded in each well of a 6 well plate in 2 ml MSC medium, containing 10% FCS. The next day, after incubation at 37° C., 10% $CO_2$ in a humidified incubator, cells are co-infected with AdCI5-hCAR (final MOI of 750) and Ad-siRNA, Ad-cDNA or control viruses at a final MOI of 1250, 2500 and 5000. Cells are incubated at 37° C., 10% $CO_2$ in a humidified incubator for a further six days. Virus is removed and replaced by 2 ml fresh MSC medium, 10% FCS. Over the next 22 days, medium is refreshed 3 times in 2 weeks. Every other time, medium is refreshed half or completely. At 28 days after the start of the experiment, the conditioned medium is removed, cells are fixed using 10% paraformaldehyde and the monolayers stained with 1 mL of ~1% Alizarin Red (Sigma, #A5533) in MilliQ water (pH adjusted to 4.2). Ad-eGFP, to assess infection efficiency, Ad-BMP2 as strong osteogenic inducer and Ad-H4-2 as a weak osteogenic factor are included in each experiment as negative and positive controls, respectively. Every experiment where Ad-H4-2 did not induce mineralization is entirely repeated.

The KD TARGET sequences of Ad-shRNAs that induced mineralization are presented in Table 6.

TABLE 6

| TARGET Id | KD TARGET Sequence (5'→3') | SEQ ID NO. | TARGET Gene Name | TARGET Gene Symbol | Genbank DNA/RNA Accession |
|---|---|---|---|---|---|
| H24-001 | CAACTTGTACCTGGGCAGC | 3 | G protein-coupled receptor 38 | GPR38 | NM_001507 |
| H24-004 | CATGCTGTTTGAGAGCATC | 6 | MAP kinase-interacting serine/threonine kinase 2 | MKNK2-MNK2 | NM_017572-SK236 |

TABLE 6-continued

| TARGET Id | KD TARGET Sequence (5'→3') | SEQ ID NO. | TARGET Gene Name | TARGET Gene Symbol | Genbank DNA/RNA Accession |
|---|---|---|---|---|---|
| H24-006 | GACGGTGTTAATGATAGCC | 8 | casein kinase 1, gamma 1 | CSNK1G1-CK1g1 | NM_022048-SK647 |
| H24-007 | CTTCGGCACTCCTGAGTTC | 9 | myosin light chain kinase | HSA247087-caMLCK | AJ247087-SK536 |
| H24-009 | ACGCAAAGTGGCCAGGAGC | 11 | tRNA isopentenyltransferase 1 | IPT | NM_017646 |
| H24-013 | CAACCTGCTGGTGCTCGTC | 15 | opsin 3 (encephalopsin, panopsin) | OPN3 | NM_014322 |
| H24-014 | CTCTCTTAGATCTGGAACC | 16 | granzyme K (serine protease, granzyme 3; tryptase II) | GZMK | NM_002104 |
| H24-015 | AGCAGGAAGGCGGACATAC | 17 | ubiquitin-specific protease 3 - ubiquitin specific protease 3 | AF073344-USP3 | AF073344-NM_006537 |
| H24-018 | TCAGGTAGTTGGTTCTGAC | 20 | coagulation factor XIII, A1 polypeptide | F13A1 | NM_000129 |
| H24-019 | CTGCGCCGAACAAATGTAC | 21 | proteasome (prosome, macropain) subunit, beta type, 3 | PSMB3 | NM_002795 |
| H24-020 | TGTGGCGACTTGTGCACAC | 22 | ClpX caseinolytic protease X homolog (E. coli) | CLPX | NM_006660 |
| H24-021 | TCTCTCAGTGTAGAATGCC | 23 | hypothetical protein FLJ14906 | FLJ14906 | NM_032859 |
| H24-024 | GTGTACTGGTACAAGGACC | 26 | matrix metalloproteinase 23A - matrix metalloproteinase 23B | MMP23A-MMP23B | NM_004659-NM_006983 |
| H24-026 | TCTCTCATCAATACTGGTC | 28 | APEX nuclease (multifunctional DNA repair enzyme) | APEX | NM_001641-NM_080648-NM_080649 |
| H24-029 | CTATGCCATCACCTTCTGC | 31 | LOC254378 | LOC254378 | XM_174812 |
| H24-030 | TGTGCCGAAGGATGTAAGC | 32 | similar to a disintegrin and metalloprotease domain 25 (testase 2) | LOC137491 | XM_070459 |
| H24-031 | CCGGGACATAACTAAATCC | 33 | similar to bile salt-dependent lipase oncofetal isoform | LOC138529 | XM_070951 |
| H24-032 | AGCAGGCTATGGGATCAAC | 34 | complement component 9 | C9 | NM_001737 |
| H24-033 | CCACAAGGTTGCAGCATTC | 35 | xylulokinase homolog (H. influenzae) | XYLB | NM_005108 |
| H24-035 | GGGCTCAGCCAGGAGATTC | 36 | chaperone, ABC1 activity of bc1 complex like (S. pombe) | CABC1-ADCK3 | NM_020247-SK609 |
| H24-036 | CAGGTAGACATGGCGGCAC | 37 | fyn-related kinase | FRK | NM_002031 |
| H24-038 | GCACGATTTGGAGGTCGCC | 39 | unc-51-like kinase 1 (C. elegans) | ULK1 | NM_003565 |
| H24-041 | GGACTCTCAGTTCAGCATC | 42 | phosphoinositide-3-kinase, class 2, beta polypeptide | PIK3C2B | NM_002646 |

TABLE 6-continued

| TARGET Id | KD TARGET Sequence (5'→3') | SEQ ID NO. | TARGET Gene Name | TARGET Gene Symbol | Genbank DNA/RNA Accession |
|---|---|---|---|---|---|
| H24-049 | GTACCTGCAGGTGCTCAGC | 1 | arginine vasopressin receptor 1B | AVPR1B | NM_000707 |
| H24-054 | GTACCTGCGGCAGTTGTTC | 54 | chemokine (C—C motif) receptor 1 | CCR1 | NM_001295 |
| H24-062 | TTCGGACACCCACAAATGC | 62 | retinal pigment epithelium-derived rhodopsin homolog | RRH | NM_006583 |
| H24-064 | GTTGTCCTGTTCTGACGTC | 63 | olfactory receptor, family 1, subfamily A, member 2 | OR1A2 | NM_012352 |
| H24-071 | CACCTGCTTTCTCAATGCC | 70 | KIAA1453 protein | KIAA1453 | NM_025090 |
| H24-073 | AGCACCTCGCTGACATTCC | 72 | sentrin/SUMO-specific protease 3 | SENP3 | NM_015670 |
| H24-078 | GCTTCTGGTGGAGAAGGAC | 77 | transglutaminase 3-like | TGM3L | XM_066181 |
| H24-079 | GTGTATGAAGTGGTCCACC | 78 | similar to solute carrier family 21 (organic anion transporter), member 8 | LOC160662 | XM_090422 |
| H24-084 | CAGTGCCAAGAAGGAGCCC | 83 | neuron navigator 2 | NAV2 | NM_018162 |
| H24-092 | ATGCAGGTCCATATGTGAC | 91 | transient receptor potential cation channel, subfamily M, member 6 | TRPM6 | NM_017662 |
| H24-093 | CCTTTCTCTGAACACGGAC | 92 | ataxia telangiectasia and Rad3 related | ATR | NM_001184 |
| H24-095 | CAGGTTCTCCTCAAACGGC | 94 | similar to TPA: G-protein coupled receptor | LOC126788 | XM_060177 |
| H24-097 | ACATCCTGCTGTCAGAGCC | 96 | thousand and one amino acid protein kinase-prostate derived STE20-like kinase PSK | TAO1 - PSK | NM_004783-NM_016151 |
| H24-099 | GTTCTCCAGTGCCATTGGC | 98 | solute carrier family 16 (monocarboxylic acid transporters), member 3 | SLC16A3 | NM_004207 |
| H24-104 | AGTGCGCATCTTCGGCCTC | 103 | fibroblast growth factor 14 | FGF14 | NM_004115 |
| H24-106 | GCCCTGATGTCCATCTTCC | 105 | NADPH-dependent FMN and FAD containing oxidoreductase | NR1 | NM_014434 |
| H24-107 | CATAGGGAAGGACACTTGC | 106 | interleukin 1 family, member 8 (eta) | IL1F8 | NM_014438 |
| H24-108 | CCTGGATGTGAGAGAGAGC | 107 | interleukin 1 family, member 8 (eta) | IL1F8 | NM_014438 |
| H24-109 | AACTTGTACTATGAAGGCC | 108 | Ras association (RalGDS/AF-6) domain family 2 | RASSF2 | NM_014737 |
| H24-110 | GTATTCTGTACACCCTGGC | 109 | adrogen-regulated short-chain dehydrogenase/reductase 1 | ARSDR1 | NM_016026 |
| H24-111 | TTCTCGCAATGGCCAATGC | 110 | peptidylprolyl isomerase (cyclophilin)-like 1 | PPIL1 | NM_016059 |

TABLE 6-continued

| TARGET Id | KD TARGET Sequence (5'→3') | SEQ ID NO. | TARGET Gene Name | TARGET Gene Symbol | Genbank DNA/RNA Accession |
|---|---|---|---|---|---|
| H24-112 | GAAGAACAGCAGCCTGGAC | 111 | RAS, dexamethasone-induced 1 | RASD1 | NM_016084 |
| H24-113 | TCAGGCGGATCTTGACAGC | 112 | dicarbonyl/L-xylulose reductase | DCXR | NM_016286 |
| H24-117 | TCTCTCCACACAAACCTTC | 116 | chromosome 20 open reading frame 121 | C20orf121 | NM_024331 |
| H24-119 | GCGAATTCCACCAGCATTC | 118 | solute carrier family 26, member 8 | SLC26A8 | NM_052961 |
| H24-120 | TGTCCAGGACCTATTGAGC | 119 | UDP glycosyltransferase 1 family, polypeptide A1 | UGT1A1 | NM_000463 |
| H24-128 | TGTGCGAGACCTCGATTTC | 127 | HMT1 hnRNP methyltransferase-like 3 (*S. cerevisiae*) | HRMT1L3 | NM_019854 |
| H24-130 | AGCATGAAAGAAACCCTGC | 129 | peroxisomal short-chain alcohol dehydrogenase | ENSG00000169066-humNRDR | ENSG00000169066-NM_021004 |
| H24-131 | GAAGATCACCATTGCTGAC | 130 | similar to peptidylpro-lylisomerase A (cyclo-philin A) - similar to Peptidylprolyl cis-trans isomerase A (PPIase) (Rotamase) (Cyclophilin A) (Cyclosporin A-binding protein) (SP18) | PPIA-LOC127711-LOC128430-LOC138130-LOC165317-LOC257232 | NM_021130-XM_060625-XM_066074-XM_070771-XM_092514-XM_172314 |
| H24-133 | TGCAGGCAAGCAGACGGTC | 132 | 3-oxoacid CoA transfer-ase 2 | OXCT2 | NM_022120 |
| H24-136 | CTTATTGTTCACATTGGCC | 135 | similar to glyceraldehyde 3-phosphate dehydrogenase | LOC170327 | XM_093255 |
| H24-138 | TCAGGTGTCCCATTCCAGC | 137 | interleukin-1 receptor-associated kinase 2 | IRAK2 | NM_001570-SK180 |
| H24-141 | GAGTCCAGCCTTCATGCCC | 140 | cytochrome P450, subfamily IIF, poly-peptide 1 | HUMCYPIIF-CYP2F1 | J02906-NM_000774 |
| H24-142 | GTCCAGCTGAAGAAGATCC | 141 | glutamate receptor, ionotropic, N-methyl D-aspartate 2A | GRIN2A | NM_000833 |
| H24-143 | TTCGGCACTGAGGTCTTGC | 142 | hypothetical protein FLJ22955 | FLJ22955 | NM_024819 |
| H24-145 | CCTGCTCTTGAGCAATAAC | 144 | tumor endothelial marker 5 precursor | TEM5 | NM_032777 |
| H24-146 | TGTCCAGACCACATGGAGC | 145 | similar to cytochrome P450, subfamily IVF, polypeptide 2; leuko-triene B4 omega-hydroxyl-ase; leukotriene-B4 20-monooxygenase | LOC126538 | XM_065152 |
| H24-148 | GATTGTGGCCAAGAAGTAC | 147 | chloride intracellular channel 6 | CLIC6 | XM_092804 |
| H24-149 | CCTCATTATCACCATGCTC | 148 | LOC167417 | LOC167417 | XM_094471 |
| H24-150 | CTGGTTATTGGCGGGTATC | 149 | similar to 25-hydroxyvitamin D-1 alpha hydroxylase, mitochondrial precursor (25-OHD-1 alpha-hydroxylase) (25-hydroxyvitamin D3 1- | LOC165245 | XM_103864 |

TABLE 6-continued

| TARGET Id | KD TARGET Sequence (5'→3') | SEQ ID NO. | TARGET Gene Name | TARGET Gene Symbol | Genbank DNA/RNA Accession |
|---|---|---|---|---|---|
| | | | alpha-hydroxylase) (VD3 1A hydroxylase) (P450C1 alpha) (P450VD1-alpha) | | |
| H24-154 | GTTCAAGAAGCTG CGCCAC | 153 | opsin 1 (cone pigments), medium-wave-sensitive (color blindness, deutan)-opsin 1 (cone pigments), long-wave-sensitive (color blindness, protan) | OPN1MW-OPN1LW | NM_000513-NM_020061 |
| H24-156 | GCAGTTCCAAGCT TGCATC | 155 | opsin 1 (cone pigments), short-wave-sensitive (color blindness, tritan) | OPN1SW | NM_001708 |
| H24-157 | GTACCTGCGCCAC TTCTTC | 156 | chemokine (C—C motif) receptor 3 | CCR3 | NM_001837 |
| H24-159 | GTCCTTCTACATC AATGCC | 158 | G protein-coupled receptor 23 | GPR23 | NM_005296 |
| H24-160 | GAAGAAGCAACT GGGAGCC | 159 | G protein-coupled receptor 64 | GPR64 | NM_005756 |
| H24-169 | CAACCTGTTCATC CTTAAC | 164 | galanin receptor 2 | GALR2 | NM_003857 |
| H24-173 | GTTCTCTCAGCAC GTTCGC | 168 | placental growth factor, vascular endothelial growth factor-related protein | PGF | NM_002632 |
| H24-180 | ATGCAGGTCAGGT TGTTTC | 175 | solute carrier family 4, sodium bicarbonate transporter-like, member 10 | SLC4A10 | NM_022058 |
| H24-185 | ACCGTGGAAGGC CTATCGC | 180 | cytochrome P450, subfamily XXIV (vitamin D 24-hydroxylase) | CYP24 | NM_000782 |
| H24-188 | TCGGCAGGGCCA GCATTTC | 183 | macrophage stimulating 1 (hepatocyte growth factor-like) | MST1 | NM_020998 |
| H24-190 | TCAGAAGGTTGTG CAGGAC | 185 | KIAA0943 protein | Apg4B | NM_013325 |
| H24-191 | CAACTTGCATGAC TACGGC | 186 | amyloid beta (A4) precursor protein (protease nexin-II, Alzheimer disease) | APP | NM_000484 |
| H24-193 | ACCAGTGGTAAAT GTCAGC | 188 | dual specificity phosphatase 5 | DUSP5 | NM_004419 |
| H24-194 | CTCTGTATCCCAT TCCCTC | 189 | mitogen-activated protein kinase kinase kinase 9 | MAP3K9 | XM_027237 |
| H24-200 | GTAGCACTCTGCG ACATGC | 195 | solute carrier family 39 (zinc transporter), member 4 | SLC39A4 | NM_017767-NM_130849 |
| H24-202 | GTTATTCTTCCAC CATGGC | 197 | nicotinamide N-methyltransferase | NNMT | NM_006169 |
| H24-205 | AGCATGACAGGA AACCTGC | 200 | UDP-glucose ceramide glucosyltransferase-like 2 | UGCGL2 | NM_020121 |
| H24-207 | CCTTGTTGGCCAA TGATTC | 202 | similar to arylacetamide deacetylase (esterase) | LOC166161 | XM_093702 |

TABLE 6-continued

| TARGET Id | KD TARGET Sequence (5'→3') | SEQ ID NO. | TARGET Gene Name | TARGET Gene Symbol | Genbank DNA/RNA Accession |
|---|---|---|---|---|---|
| H24-211 | CAAGTTCTCCTGCAAGTTC | 206 | ATPase, H+/K+ exchanging, beta polypeptide | ATP4B | NM_000705 |
| H24-218 | CAACATCCCAACTGTGGTC | 213 | glutathione reductase | GSR | NM_000637 |
| H24-219 | TATCCTGACCTTCCTGCGC | 214 | potassium voltage-gated channel, subfamily G, member 1 | KCNG1 | NM_002237 |
| H24-224 | TATTCGTGCGGAGGAAGAC | 219 | chromosome 9 open reading frame 96 | SgK071 | SK521 |
| H24-225 | ATGGGCTTCAACAGCCACC | 220 | arginine vasopressin receptor 1B | AVPR1B | NM_000707 |

EXAMPLE 7

Drug Discovery Against the Identified TARGETs

Compounds are screened for binding to the polypeptides of the present invention. The affinity of the compounds to the polypeptides is determined in a displacement experiment. Such displacement experiments are well known in the art, and can be considered as a common technique among others to identify compounds that bind to polypeptides.

In brief, the polypeptides of the present invention are incubated with a labeled (radio-labeled, fluorescent- or antibody-labeled, or any other detectable label) ligand that is known to bind to the polypeptide and is further incubated with an unlabeled compound.

The displacement of the labeled ligand from the polypeptide is determined by measuring the amount of labeled ligand that is still associated with the polypeptide. The amount of the labeled ligand associated with the peptide is an indication of the affinity for the unlabeled compound.

The amount of labeled ligand associated with the polypeptide is plotted against the concentration of the unlabeled compound to calculate IC50 values. This value reflects the binding affinity of the unlabeled compound to its TARGET, i.e. the polypeptides of the present invention.

Compounds are considered strong binders, when having an IC50 in the nanomolar and even picomolar range. Compounds that have an IC50 of at least 10 micromol or even better in the nmol to pmol range are applied in either the bone alkaline phosphatase assay (BAP) and/or in assays to determine their effect on the induction of osteoblast markers and osteoblast function. Compounds with a lower IC50 are generally considered as of less interest. The polypeptides of the present invention can be prepared in a number of ways depending on whether the assay will be run on cells, cell fractions, or biochemically on purified proteins. Such preparations are well known in the art, as are the different assays.

EXAMPLE 8

Osteoclast Assays: Validate Anti-resorptive Activity of Identified TARGETs

Throughout life, the skeleton is in a constant state of remodeling. Focal areas of bone are resorbed by osteoclasts and then replaced by bone matrix newly formed by osteoblasts. The development of osteoporosis is characterized by severe bone loss due to the deregulation of the balance between osteoclast and osteoblast activity, leading to an increased osteoclast-mediated bone resorption.

Osteoclasts emanate from cells of the monocyte/macrophage lineage. In vivo, the differentiation of osteoclast precursor cells towards osteoclasts is controlled by two central factors expressed by stromal cells (MPCs): receptor activator of NFκB ligand (RANKL) and osteoprotegerin (OPG). RANKL is a membrane bound ligand expressed on the surface of MPCs which drives osteoclast differentiation. OPG is a soluble decoy receptor for RANKL which inhibits osteoclast differentiation by scavenging active RANKL. The balance between RANKL and OPG expression by MPCs determines the level of osteoclast differentiation.

As MPCs control the differentiation of osteoclasts, it is important to know the effect of the identified TARGET Ad-siRNAs on osteoclast differentiation or activity. Target Ad-siRNAs that decrease osteoclast differentiation/activity, are very valuable, as these are expected to increase bone apposition by two mechanisms: increase of differentiation/activity of osteoblasts and decrease in osteoclast activity. As illustrated by various precedents (Thirunavukkarasu et al., (2000) *J Biol Chem* 275 : 25163-72 ; Yamada et al., (2003) *Blood* 101: 2227-34) such a pleiotropic effect of osteogenic factors can be expected.

Osteoclast Differentiation Assay

The effect of osteogenic factors on osteoclastogenesis is evaluated through two types of assays.

In a first assay setup, a coculture of MPCs with primary human mononuclear cells is performed. The effect of the infection of the MPC monolayer with a knock-down virus on its capacity to support osteoclastogenesis is evaluated. The desired effect is the following: knock-down of the Ad-siRNA TARGET gene expression in the MPCs should inhibit osteoclast differentiation driven by a physiological trigger as e.g. a mixture of 10 nM 1,25(OH)$_2$vitD$_3$ and 50 nM M-CSF. The monocytes used can be derived from bone marrow or peripheral blood. In the present example, a differentiation experiment based on peripheral blood derived mononuclear cells (PBMCs) is described. MPCs (obtained from Cambrex/Biowhittaker, Verviers, Belgium) are seeded in 96 well plates (1000 cells per well) in α-MEM medium (GIBCO-Life Technologies) supplemented with 10% FBS and a day later, these are infected with a TARGET Ad-siRNA. At least three days later, 100 000 PBMCs per well are added as well as M-CSF (R&D systems, 50 ng/ml final concentration). Half the volume of medium is refreshed twice a week by medium +50 ng/ml M-CSF and 10 nM 1,25(OH)$_2$vitD$_3$. Readout is performed 14 days after addition of the PBMCs to the coculture. Spontaneous osteoclast differentiation driven by the physiologically relevant mixture of triggers can be assessed by multiple readouts. Microscopic assessment of the number of 'TRAP positive', multinucleated cells per well is a generally accepted measure for the level of osteoclast differentiation. 'TRAP positive' means that the cells possess a tartrate resistant acidic phosphatase (TRAP) activity. To assess this, the coculture is subjected to an in situ TRAP staining performed according to the Acid Phosphatase detection kit (SIGMA, 386-A). Positive cells aquire a purple color upon treatment. As an alternative readout, a marker specific for mature osteoclasts is measured e.g. TRACP5b (tartrate resistant acidic phosphatase type 5b), calcitonin receptor (CTR) or Cathepsin K (CTSK). Measurement of the amounts of osteoclast-derived tartrate resistant acidic phosphatase protein (TRACP5b) in the coculture supernatant is performed by a commercially available ELISA (BoneTRAP assay, Sba sciences, Turku, Finland). CTR or CTSK are detected by immunocytochemistry, upon application of following general protocol. Medium is removed and the coculture is fixed (4% paraformaldehyde, 0.1% TritonX-100, 4° C., 30 min), washed and blocking buffer (PBS+1% BSA+0.1% Tween20) is added for an incubation of at least 4hrs. The blocking buffer is removed and the primary antibody directed against CathepsinK (e.g. Oncogene, IM55L) or Calcitonin receptor (e.g. Serotec, AHP635), dissolved at the desired concentration in a suited buffer (e.g. 0.05M Tris.HCl pH 7.4, 1% BSA), is added to the wells. Incubation is performed overnight, 4° C. The mixture is removed, the cells washed (PBS+0.1% Tween20) and the suited, HRP conjugated secondary antibody, diluted in the same buffer as the primary antibody, is added. After an incubation of at least 4 hrs, a washing step is performed (PBS+0.1% Tween20) and luminol (a substrate for HRP yielding a luminescent signal: BM Chemiluminescence ELISA Substrate [POD] (luminol), Roche Diagnostics, Cat No 1582950) is added. After 5 min incubation, readout is performed with a luminometer (Luminoskan Ascent, Labsystem). The 2 assays described (assessment of the amount of multinuclear cells and imnmunochemistry for the detection of osteoclast-specific markers) allow to assess the differentiation of the mononuclear cells towards osteoclasts, but do not yield information about the bone resorptive activity of the osteoclasts formed.

Activity of the osteoclasts is measured in the pit formation assay. For this purpose, the co-culture and infection of cells is performed as described for assays described above with the difference that a bone-like substrate is present at the bottom of the well in which the co-culture is performed. This bone-like substrate can be a dentin slice (e.g. Kamiya Biomedical Company, Seattle (Cat No KT018)) or equivalent (Calcium carbonate coating, OAAS™, Gentaur; Biocoat™ Osteologic™, BD Biosciences) that is commercially available. The co-culture is performed for at least 14 days on the bone like substrate. Cells are then removed by treatment with sodium hypochlorite and the area resorbed by the osteoclasts (the resorption pit) can be assessed microscopically. This can be facilitated by the treatment of the surface of the dentin slice with toluidine blue.

In a second assay setup, the effect of the infection of the osteoclast precursor cells (PBMCs or BMMCs) with a TARGET virus on its ability to differentiate towards an osteoclast is measured in a monoculture assay. For this purpose, the monocytes (PBMCs or BMMCs) are seeded in a 384 well plate in aMEM medium supplemented with 10% serum and 25 ng/ml recombinant M-CSF (R&D systems). One day after seeding, the cells are infected with TARGET Ad-siRNAs. Four days after infection, recombinant RANKL is added to the wells (25 ng/ml, R&D systems). Medium is refreshed twice a week. Fourteen days after addition of RANKL, the differentiation of the monocytes towards osteoclasts is measured using one of the readouts described for the former assay setup. This assay allows the identification of factors that are indispensable for the response of osteoclast precursor cells to M-CSF or RANKL.

PBMC Isolation

PBMCs are obtained from peripheral blood (obtained from patients after informed consent) subjected to the following protocol. Blood is aseptically poured into 50 ml Falcon tubes and spun at 3000 g for 10 min at 25° C. The buffy coat is then collected and diluted 1:1 with PBS. The diluted buffy coat is poured on top of 20 ml Lymphoprep (Sigma) contained in a 50 ml Falcon tube. Upon centrifugation (35 min at 400 g at 25° C.), a white layer of mononuclear cells on top of the Lymphoprep is collected and washed twice with PBS (centrifugation at 200 g, 10 min, 25° C.) and rediluted in 7 ml PBS. This solution is pipetted onto a layer of 7 ml of hyperosmolar Percoll gradient contained in a 15 ml Falcon tube and centrifuged 35 min at 400 g at 25° C. The hyperosmolar Percoll gradient is prepared as follows: 1 volume of 1.5 M NaCl and 9 volumes of Percoll (Pharmacia, d=1,130 g/ml) are mixed. This mixture is added 1:1 to a PBS/Citrate buffer (NaH2PO4 1.49 mM, Na2HPO4 9.15 mM, NaCl 139.97 mM, Na-citrate (dihydrate) 13 mM, pH 7.2). After centrifugation, monocytes form a discrete ring on top of the gradient. Monocytes are collected and washed in culture medium. Cells are then ready to use in assays.

EXAMPLE 9

Analysis of 'off-target' Knock Down Effect

SiRNAs exert knock-down of gene expression through a recently discovered and partially understood mechanism. It is generally accepted that the specific annealing of the siRNA sequence to mRNA is responsible for a gene-specific 'on-target' knock-down. However, it cannot be excluded yet that limited mismatching between the siRNA and another mRNA can induce 'off-target' down-regulation of gene expression.

In order to exclude that the knock-down of (an) 'off-target' mRNA(s) was responsible for the observed osteogenic effect, additional siRNAs/shRNAs are designed for 38 targets that induced mineralization (Example 6) using stringent design criteria. The additional Ad-shRNAs are then tested in the BAP assay.

To address the question of possible 'off-target' effects, additional siRNA sequences are designed that align perfectly with the mRNA targeted by the original siRNA. Preferred siRNA sequences do not align to other mRNAs. However, in some cases only siRNAs could be designed that showed some overlap to other mRNAs. For siRNAs that aligned to a minimal number of 'off-target' mRNAs (maximum of 2 basepairs non-identity checked for every position of the 19mer) the following rules are applied: the putative 'off-target' mRNAs must be different from the putative 'off-target' mRNAs identified for the original siRNA; and putative 'off-target' mRNAs must be different from the putative 'off-target' mRNAs identified for all original target siRNAs. The only exception to these rules made during the course of these experiments are siRNAs designed for PPIA.

For each of the 38 selected target genes, 7 additional siRNAs were designed and processed to derive recombinant adenoviruses. All siRNAs are sequenced upon cloning, to verify their identity and exclude errors due to the oligonucleotide synthesis.

261 Ad-shRNAS were successfully generated and tested in the BAP assay at 3 MOIs in 2 independent experiments, in parallel with the original 38 Ad-shRNAs.

Recombinant adenoviruses encoding the designed shR-NAs (Ad-shRNAs) are produced, titered, aliquoted in 96 well plates and stored at −80° C. These plates were processed in the primary BAP assay as follows:

MPC cells wearere seeded with a Multidrop 384 (Labsystems) in black 384 well plates with clear bottom (Costar or Nunc) in 60 µl MSC medium containing 10% fetal calf serum (Progentix, The Netherlands), at a density of 500 cells per well. One day later, a 96 well plate containing aliquoted Ad-shRNAs and another containing negative and positive control viruses (knock-down control plate) are thawed and virus aliquots transferred to the MPC plate using a 96-channel dispenser (Tecan Freedom 200 equipped with a TeMO96 and a RoMa plate handler, Tecan AG, Switzerland). For the control plate, 1 µL virus stock (average titer of $2 \times 10^9$ viral particles per ml) is transferred to the 384 well screening plates. On the control plate (see FIG. 3), negative (N1, N2, N3) and positive (P1, P2) control viruses are diagonally distributed over the plate. N1, N2, N3: Ad-siRNAs targeting the eGFP, mannose-6-phosphate-receptor and luciferase mRNAs, respectively. P1 and P2: Ad-siRNAs targeting the PRKCN (H24-010) and MPP6 (H24-011) mRNAs. P3: Ad-eGFP: overexpression of eGFP allows monitoring of infection efficiency.

Figure 11:
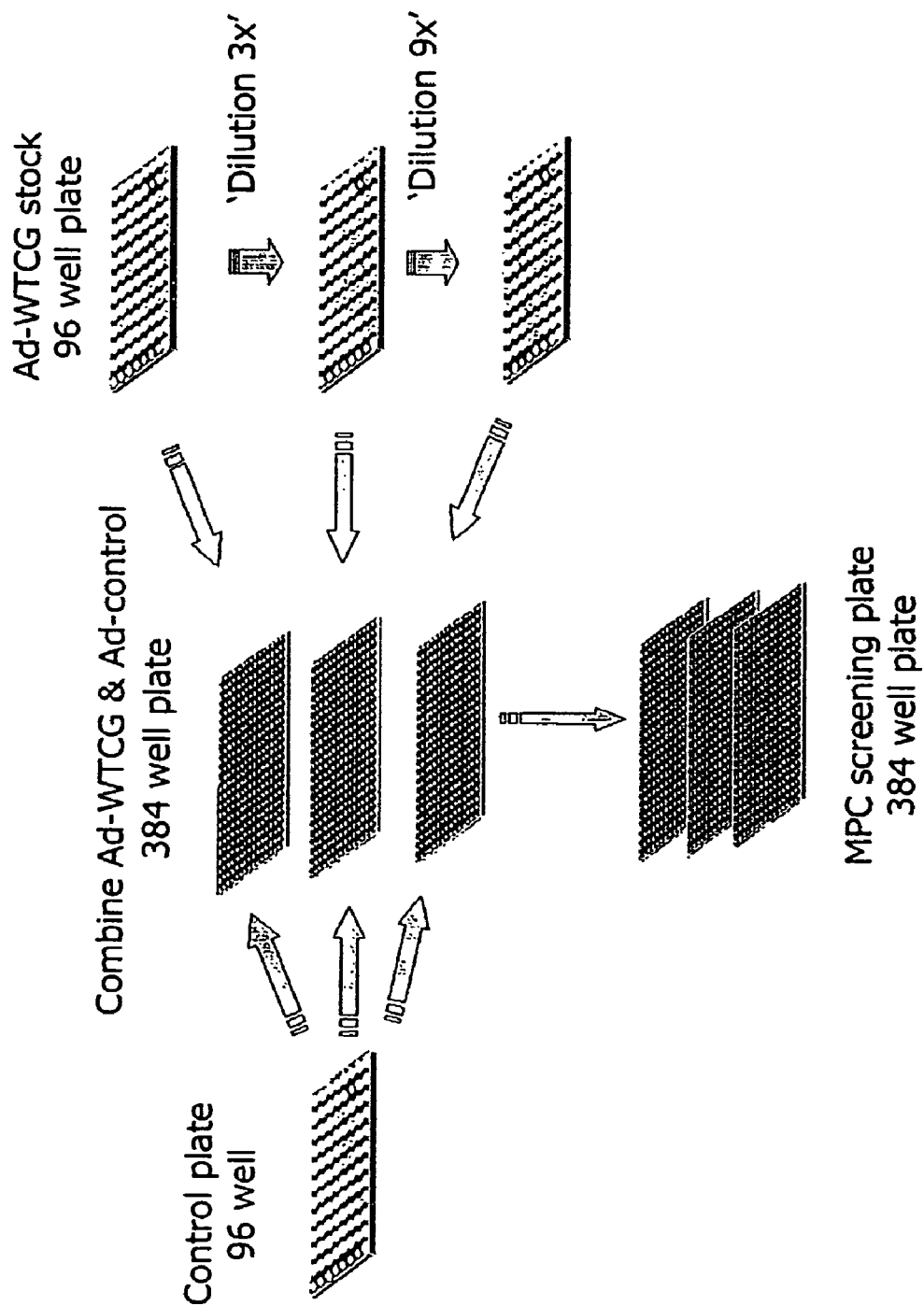

The Ad-shRNAs are screened at 3 multiplicities of infection (MOIs): 12,000, 4,000 and 1,333. Ad-shRNAs are aliquotted into the inner wells of a 96 well plate at a titer of $1.5 \times 10^9/4$ µl and 1/3 and 1/9 dilutions are derived of this plate (FIG. 11). The resulting 3 plates are used to infect $3 \times 384$ well plates seeded with MSCs, in the A1 and B2 positions of each quadrant using robotics. The viruses from the control plate are pipetted in the A2 and B1 positions.

Next, 5 µl of adenovirus expressing the human coxsackie and adenovirus receptor (hCAR) (AdC15-hCAR/AdC20-hCAR) is transferred into these wells (final MOI of 155) from a 96 well V-bottom plate with the aid of the 96-channel dispenser.

Plates are then incubated at 37° C., 10% $CO_2$ in a humidified incubator for four days. Four days post infection, the medium containing the adenoviruses is replaced by 60 µl fresh MSC medium containing 10% FCS free of virus. After an additional nine days of incubation, medium is removed, 15 µL of a 4-methylumbelliferylphosphate solution (Sigma, #M3168) is added to each well and the fluorescence of 4-methyl-umbelliferone released by the alkaline phosphatase activity is measured after 15 min incubation at 37° C. using a fluorimeter (excitation: 360 nm; emission: 440 nm; FluoStar, BMG).

All Ad-shRNAs viruses are screened in duplicate at 3 MOIs in two independent screens. Thresholds are calculated for hit calling using either all negative controls present in one screening round ('Global' analysis) or using the negative controls present on one screening plate ('Local' analysis). Threshold is set at a BAP signal higher than the mean plus 3 times the standard deviation of negative controls. The two individual datapoints for each virus in the batch are analyzed independently. Hits are selected if one Ad-shRNAs scored at least at one MOI in duplicate in at least one of the 2 screens above the threshold (see Table 7).

A 'Global' analysis of the data identified 61 siRNAs targeting 32 loci and a 'Local' analysis' identified 84 siRNAs targeting 35 loci. The identity of the 38 selected genes is presented in Table 7 together with the final number of siRNAs that scored in the BAP assay. In this Table, the numbers indicate all siRNAs that scored in the BAP assay, including the original 38 siRNAs. Based on the 'Global' and 'Local' analysis, an average of 2.61 and 3.21 constructs respectively are identified for each of the 38 validated targets.

All original 38 Ad-shRNAs scored in the BAP assay based on both the 'Global' and 'Local' analysis.

In conclusion, additional Ad-shRNAs targeting 38 selected targets are designed and constructed. Negative controls present on the control plates are used per plate ('Local' analysis) or per batch of plates ('Global' analysis) to determine the cutoff for hit calling.

The 'Global' analysis results in 61 viruses that scored positive in the BAP assay, confirming 32 of the 38 validated targets. The 'Local' analysis results in 84 viruses that scored positive in the BAP assay, confirming 35 of the 38 validated targets. All original 38 Ad-shRNA viruses score in the BAP assay when using either the 'Global' or the 'Local' analysis. The targets LOC160662, PPIA and SLC39A4 are identified only in the 'Local' analysis.

TABLE 7

| TARGET Gene Symbol | Global analysis - Redundancy | Local analysis - Redundancy |
|---|---|---|
| APG4B | 2 | 3 |
| C13orf6 | 2 | 2 |
| C20orf121 | 3 | 4 |
| CCR1 | 3 | 4 |
| CCR3 | 2 | 2 |
| CEL | 2 | 4 |
| CLIC6 | 2 | 2 |
| CSNK1G1 | 2 | 3 |
| DUSP5 | 2 | 2 |
| FLJ22955 | 3 | 4 |
| FRK | 3 | 3 |
| GPR124 | 2 | 3 |
| GPR23 | 2 | 3 |
| GPR64 | 4 | 5 |
| Grin2a-GRIN2A | 7 | 6 |
| GZMK | 2 | 2 |
| HRMT1L3 | 2 | 2 |
| IRAK2 | 4 | 4 |
| LOC160662 - LST-3 | 1 | 2 |
| LOC167417 - GPR150 | 4 | 5 |
| LOC254378 | 3 | 4 |
| MAP3K9 | 4 | 5 |
| MLNR | 4 | 3 |
| MMP23B-MMP23A | 3 | 2 |
| MNK2 | 2 | 3 |
| OR1A2 | 4 | 6 |
| PPIA | 1 | 3 |
| RASD1 | 4 | 5 |
| RDH11 | 3 | 4 |
| SENP3 | 4 | 4 |
| SLC16A3 | 2 | 3 |
| SLC26A8 | 1 | 1 |
| SLC39A4 | 1 | 2 |
| SLC4A10 | 1 | 1 |
| TAO1 | 3 | 4 |
| TAS1R3 | 2 | 3 |
| TRPM6 | 1 | 1 |
| ULK1 | 2 | 3 |

EXAMPLE 10

Identification of Small Molecules that Inhibit TARGET Kinase Activity

Compounds are screened for inhibition of the activity of the TARGETS that are kinase polypeptides. The affinity of the compounds to the polypeptides is determined in an experiment detecting changed reaction conditions after phosphorylation. The TARGET kinase polypeptides are incubated with its substrate and ATP in an appropriate buffer. The combination of these components results in the in vitro phosphorylation of the substrate. Sources of compounds include commercially available screening library, peptides in a phage display library or an antibody fragment library, and compounds that have been demonstrated to have binding affinity for a TARGET kinase.

The TARGET kinase polypeptides can be prepared in a number of ways depending on whether the assay will be run using cells, cell fractions or biochemically, on purified proteins. The polypeptides can be applied as complete polypeptides or as polypeptide fragments, which still comprise TARGET kinase catalytic activity.

Identification of small molecules inhibiting the activity of the TARGET kinase polypeptides is performed by measuring changes in levels of phosphorylated substrate or ATP. Since ATP is consumed during the phosphorylation of the substrate, its levels correlate with the kinase activity. Measuring ATP levels via chemiluminescent reactions therefore represents a method to measure kinase activity in vitro (Perkin Elmer). In a second type of assay, changes in the levels of phosphorylated substrate are detected with phosphospecific agents and are correlated to kinase activity. These levels are detected in solution or after immobilization of the substrate on a microtiter plate or other carrier. In solution, the phosphorylated substrate is detected via fluorescence resonance energy transfer (FRET) between the Eu labeled substrate and an APC labeled phosphospecific antibody (Perkin Elmer), via fluorescence polarization (FP) after binding of a phosphospecific antibody to the fluorescently labeled phosphorylated substrate (Panvera), via an Amplified Luminescent Proximity Homogeneous Assay (ALPHA) using the phosphorylated substrate and phosphospecific antibody, both coupled to ALPHA beads (Perkin Elmer) or using the IMAP binding reagent that specifically detects phosphate groups and thus alleviates the use of the phosphospecific antibody (Molecular Devices). Alternatively, the substrate is immobilized directly or by using biotin-streptavidin on a microtiter plate. After immobilization, the level of phosphorylated substrate is detected using a classical ELISA where binding of the phosphospecific antibody is either monitored via an enzyme such as horseradish peroxidase (HRP) or alkaline phospahtase (AP) which are either directly coupled to the phosphospecific antibody or are coupled to a secondary antibody. Enzymatic activity correlates to phosphorylated substrate levels. Alternatively, binding of the Eu-labeled phosphospecific antibody to the immobilized phosphorylated substrate is determined via time resolved fluorescence energy (TRF) (Perkin Elmer). In addition, the substrate can be coated on FLASH plates (Perkin Elmer) and phosphorylation of the substrate is detected using $^{33}P$ labeled ATP or $^{125}I$ labeled phosphospecific antibody.

Small molecules are randomly screened or are preselected based upon drug class, (i.e. known kinase inhibitors), or upon virtual ligand screening (VLS) results. VLS uses virtual docking technology to test large numbers of small molecules in silico for their binding to the polypeptide of the invention. Small molecules are added to the kinase reaction and their effect on levels of phosphorylated substrate is measured with one or more of the above-described technologies.

Small molecules that inhibit the kinase activity are identified and are subsequently tested at different concentrations. $IC_{50}$ values are calculated from these dose response curves. Strong binders have an $IC_{50}$ in the nanomolar and even picomolar range. Compounds that have an $IC_{50}$ of at least 10 micromol or better (nmol to pmol) are applied in alkaline phosphatase assay or bone mineralization assay to check for their effect on the induction of osteogenesis.

EXAMPLE 11

Ligand Screens for TARGET GPCRs

Reporter Gene Screen.

Mammalian cells such as Hek293 or CHO-K1 cells are either stably transfected with a plasmid harboring the luciferase gene under the control of a cAMP dependent promoter (CRE elements) or transduced with an adenovirus harboring a luciferase gene under the control of a cAMP dependent promoter. In addition reporter constructs can be used with the luciferase gene under the control of a $Ca^{2+}$ dependent promoter (NF-AT elements) or a promoter that is controlled by activated NF-κB. These cells, expressing the reporter construct, are then transduced with an adenovirus harboring the cDNA of a TARGET GPCR. Forty (40) hours after transduction the cells are treated with the following:

a) an agonist for the receptor and screened against a large collection of reference compounds comprising peptides (LO-PAP, Sigma Aldrich), lipids (Biomol, TimTech), carbohydrates (Specs), natural compounds (Specs, TimTech), small chemical compounds (Tocris), commercially available screening libraries, and compounds that have been demonstrated to have binding affinity for a polypeptide comprising an amino acid sequence selected from the group consisting of the SEQ ID NOs of the TARGET GPCRs; or b) a large collection of reference compounds comprising peptides (LOPAP, Sigma Aldrich), lipids (Biomol, TimTech), carbohydrates (Specs), natural compounds (Specs, TimTech), small chemical compounds (Tocris), commercially available screening libraries, and compounds that have been demonstrated to have binding affinity for a polypeptide comprising an amino acid sequence selected from the group consisting of SEQ ID NOs of the TARGET GPCRs.

Compounds, which decrease the agonist induced increase in luciferase activity or the constitutive activity, are considered to be antagonists or inverse agonists for a TARGET GPCR. These compounds are screened again for verification and screened against their effect on osteoblast differentiation. The compounds are also screened to verify binding to the GPCR. The binding, osteogenesis and reporter activity assays can be performed in essentially any order to screen compounds.

In addition, cells expressing the NF-AT reporter gene can be transduced with an adenovirus harboring the cDNA encoding the α-subunit of $G_{15}$ or chimerical Gα subunits. $G_{15}$ is a promiscuous G protein of the $G_q$ class that couples to many different GPCRs and as such re-directs their signaling towards the release of intracellular $Ca^{2+}$ stores. The chimerical G alpha subunits are members of the $G_s$ and $G_{i/o}$ family by which the last 5 C-terminal residues are replaced by those of $G_{\alpha q}$, these chimerical G-proteins also redirect cAMP signaling to $Ca^{2+}$ signaling.

FLIPR Screen.

Mammalian cells such as Hek293 or CHO-K1 cells are stably transfected with an expression plasmid construct harboring the cDNA of a TARGET GPCR. Cells are seeded, grown, and selected until sufficient stable cells can be obtained. Cells are loaded with a $Ca^{2+}$ dependent fluorophore such as Fura3 or Fura4. After washing away the excess of fluorophore the cells are screened against a large collection of reference compounds comprising peptides (LOPAP, Sigma Aldrich), lipids (Biomol, TimTech), carbohydrates (Specs), natural compounds (Specs, TimTech), small chemical compounds (Tocris), commercially available screening libraries, and compounds that have been demonstrated to have binding affinity for a polypeptide comprising an amino acid sequence selected from the group consisting of SEQ ID NOs of the TARGET GPCRs, by simultaneously adding an agonist (alternatively no agonist need be added if the constitutive activity of the receptor is used) and a compound to the cells. Activation of the receptor is measured as an almost instantaneously increase in fluorescence due to the interaction of the fluorophore and the $Ca^{2+}$ that is released. Compounds that reduce or inhibit the agonist induced increase in fluorescence (or constitutive fluorescence) are considered to be antagonists or inverse agonists for the receptor they are screened against. These compounds are screened again to measure the amount of osteoblast differentiation as well as binding to a TARGET GPCR.

AequoScreen.

CHO cells, stably expressing Apoaequorin are stably transfected with a plasmid construct harboring the cDNA of a TARGET GPCR. Cells are seeded, grown, and selected until sufficient stable cells can be obtained. The cells are loaded with coelenterazine, a cofactor for apoaequorin. Upon receptor activation intracellular $Ca^{2+}$ stores are emptied and the aequorin will react with the coelenterazine in a light emitting process. The emitted light is a measure for receptor activation. The CHO, stable expressing both the apoaequorin and the receptor are screened against a large collection of reference compounds comprising peptides (LOPAP, Sigma Aldrich), lipids (Biomol, TimTech), carbohydrates (Specs), natural compounds (Specs, TimTech), small chemical compounds (Tocris), commercially available screening libraries, and compounds that have been demonstrated to have binding affinity for a polypeptide comprising an amino acid sequence selected from the group consisting of SEQ ID NOs of the TARGET GPCRs, by simultaneously adding an agonist (alternatively no agonist need be added if the constitutive activity of the receptor is used) and a compound to the cells. Activation of the receptor is measured as an almost instantaneously light flash due to the interaction of the apoaequorin, coelenterazine, and the $Ca^{2+}$ that is released. Compounds that reduce or inhibit the agonist induced increase in light or the constitutive activity are considered to be antagonists or inverse agonists for the receptor they are screened against. These compounds are screened again to measure the amount of osteoblast differentiation as well as binding to a TARGET GPCR.

In addition, CHO cells stable expressing the apoaequorin gene are stably transfected with a plasmid construct harboring the cDNA encoding the α-subunit of G15 or chimerical $G_\alpha$ subunits. $G_{15}$ is a promiscuous G protein of the $G_q$ class that couples to many different GPCRs and as such redirects their signaling towards the release of intracellular $Ca^{2+}$ stores. The chimerical G alpha subunits are members of the $G_s$ and $G_{i/o}$ family by which the last 5 C-terminal residues are replaced by those of $G_{\alpha q}$, these chimerical G-proteins also redirect cAMP signaling to $Ca^{2+}$ signaling.

Screening for Compounds that Bind to the GPCR Polypeptides (Displacement Experiment)

Compounds are screened for binding to the TARGET GPCR polypeptides. The affinity of the compounds to the polypeptides is determined in a displacement experiment. In brief, the GPCR polypeptides are incubated with a labeled (radiolabeled, fluorescent labeled) ligand that is known to bind to the polypeptide and with an unlabeled compound. The displacement of the labeled ligand from the polypeptide is determined by measuring the amount of labeled ligand that is still associated with the polypeptide. The amount associated with the polypeptide is plotted against the concentration of the compound to calculate $IC_{50}$ values. This value reflects the binding affinity of the compound to its TARGET, i.e. the TARGET GPCR polypeptides. Strong binders have an $IC_{50}$ in the nanomolar and even picomolar range. Compounds that have an $IC_{50}$ of at least 10 micromol or better (nmol to pmol) are applied an osteoblast differentiation assay to check for their effect on osteogenesis. The TARGET GPCR polypeptides can be prepared in a number of ways depending on whether the assay are run on cells, cell fractions or biochemically, on purified proteins. Screening for compounds that bind to a TARGET GPCR (generic GPCR screening assay) When a G protein receptor becomes constitutively active, it binds to a G protein ($G_q$, $G_s$, $G_i$, $G_o$) and stimulates the binding of GTP to the G protein. The G protein then acts as a GTPase and slowly hydrolyses the GTP to GDP, whereby the receptor, under normal conditions, becomes deactivated. However, constitutively activated receptors continue to exchange GDP to GTP. A non-hydrolyzable analog of GTP, [$^{35}$S]GTPγS, can be used to monitor enhanced binding to membranes which express constitutively activated receptors. It is reported that [$^{35}$S]GTPγS can be used to monitor G protein coupling to membranes in the absence and presence of ligand. Moreover, a preferred approach is the use of a GPCR-G protein fusion protein. The strategy to generate a TARGET GPCR-G protein fusion protein is well known for those known in the art. Membranes expressing TARGET GPCR-G protein fusion protein are prepared for use in the direct identification of candidate compounds such as inverse agonist. Homogenized membranes with TARGET GPCR-G protein fusion protein are transferred in a 96-well plate. A pin-tool is used to transfer a candidate compound in each well plus [$^{35}$S]GTPγS, followed by incubation on a shaker for 60 minutes at room temperature. The assay is stopped by spinning of the plates at 4000 RPM for 15 minutes at 22° C. The plates are then aspirated and radioactivity is then read.

Receptor Ligand Binding Study on Cell Surface

The receptor is expressed in mammalian cells (Hek293, CHO, COS7) by adenoviral transducing the cells (see U.S. Pat. No. 6,340,595). The cells are incubated with both labeled ligand (iodinated, tritiated, or fluorescent) and the unlabeled compound at various concentrations, ranging from 10 pM to 10 µM (3 hours at 4° C.: 25 mM HEPES, 140 mM NaCl, 1 mM $CaCl_2$, 5 mM $MgCl_2$ and 0.2% BSA, adjusted to pH 7.4). Reactions mixtures are aspirated onto PEI-treated GF/B glass filters using a cell harvester (Packard). The filters are washed twice with ice cold wash buffer (25 mM HEPES, 500 mM NaCl, 1 mM $CaCl_2$, 5 mM $MgCl_2$, adjusted to pH 7.4). Scintillant (MicroScint-10; 35 µl) is added to dried filters and the filters counted in a (Packard Topcount) scintillation counter. Data are analyzed and plotted using Prism software (GraphPad Software, San Diego, Calif.). Competition curves are analyzed and $IC_{50}$ values calculated. If one or more data points do not fall within the sigmoidal range of the competition curve or close to the sigmoidal range the assay is repeated and concentrations of labeled ligand and unlabeled compound adapted to have more data points close to or in the sigmoidal range of the curve.

Receptor Ligand Binding Studies on Membrane Preparations

Membranes preparations are isolated from mammalian cells (Hek293, CHO, COS7) cells over expressing the receptor is done as follows: Medium is aspirated from the transduced cells and cells are harvested in 1× PBS by gentle scraping. Cells are pelleted (2500 rpm 5 min) and resuspended in 50 mM Tris pH 7.4 ($10 \times 10^6$ cells/ml). The cell pellet is homogenized by sonicating 3×5 sec (UP50H; sonotrode MS1; max amplitude: 140 µm; max Sonic Power Density: 125W/cm²). Membrane fractions are prepared by centrifuging 20 min at maximal speed (13,000 rpm ~15,000 to 20,000g or rcf). The resulting pellet is resuspended in 500 µl 50 mM Tris pH 7.4 and sonicated again for 3×5 sec. The membrane fraction is isolated by centrifugation and finally resuspended in PBS. Binding competition and derivation of $IC_{50}$ values are determined as described above.

Internalization Screen (1)

Activation of a GPCR-associated signal transduction pathway commonly leads to translocation of specific signal transduction molecules from the cytoplasm to the plasma membrane or from the cytoplasm to the nucleus. Norak has developed their transfluor assay based on agonist-induced translocation of receptor-β-arrestin-GFP complex from the cytosol to the plasma membrane and subsequent internalization of this complex, which occurs during receptor desensitization. A similar assay uses GFP tagged receptor instead of β-arrestin. Hek293 cells are transduced with a TARGET GPCR vector that translates for a TARGET GPCR-EGFP fusion protein. 48 hours after transduction, the cells are set to fresh serum-free medium for 60 minutes and treated with a ligand for 15, 30, 60 or 120 minutes at 37° C. and 5% $CO_2$.

After indicated exposure times, cells are washed with PBS and fixed with 5% paraformaldehyde for 20 minutes at RT. GFP fluorescence is visualized with a Zeiss microscope with a digital camera. This method aims for the identification of compounds that inhibit a ligand-mediated (constitutive activity-mediated) translocation of the fusion protein to intracellular compartments.

Internalization Screen (2)

Various variations on translocation assays exists using β-arrestin and β-galactosidase enzyme complementation and BRET based assays with receptor as energy donor and β-arrestin as energy acceptor. Also the use of specific receptor antibodies labeled with pH sensitive dyes are used to detect agonist induced receptor translocation to acidic lysosomes. All of the translocation assays are used for screening for both agonistic and antagonistic acting ligands.

Melanophore Assay (Arena Pharmaceutical)

The melanophore assay is based on the ability of GPCRs to alter the distribution of melanin containing melanosomes in *Xenopus* melanophores. The distribution of the melanosomes depends on the exogenous receptor that is either $G_{i/o}$ or $G_{s/q}$ coupled. The distribution of the melanosomes (dispersed or aggregated) is easily detected by measuring light absorption. This type of assay is used for both agonist as well as antagonist compound screens.

REFERENCES

Cortez-Retamozo et al. (2004) Cancer Res 64: 2853-7.
Franceschi R T and Xiao G (2003) J Cell Biochem 8:446-454.
Lipinsky, C A, et al. (2001) Adv Drug Deliv Rev 46: 3-26.
Nakashima K, de Crombrugghe B. (2003) Trends Genet. 19(8):458-66.
Marzia M, et al. (2000) J Cell Biol 151:311.
Thirunavukkarasu et al., (2000) J Biol Chem 275: 25163-72.
Yamada et al. (2003) Blood 101: 2227-34.
Zhang et al. (2000) PNAS 97: 10549-10554.

SEQUENCE LISTING (1133 sequences)

SEQ ID NO: 1 - DNA, 19 bp, Artificial Sequence
  Synthetic oligonucleotide
gtacctgcaggtgctcagc

SEQ ID NO: 2 - DNA, 19 bp, Artificial Sequence
  Synthetic oligonucleotide
atgggcttcaacagccacc

SEQ ID NO: 3 - DNA, 19 bp, Artificial Sequence
  Synthetic oligonucleotide
caacttgtacctgggcagc

SEQ ID NO: 4 - DNA, 19 bp, Artificial Sequence
  Synthetic oligonucleotide
ggtgaaggaggtgctggac

SEQ ID NO: 5 - DNA, 19 bp, Artificial Sequence
  Synthetic oligonucleotide
gaatctcttccgcaagatc

SEQ ID NO: 6 - DNA, 19 bp, Artificial Sequence
  Synthetic oligonucleotide
catgctgtttgagagcatc

SEQ ID NO: 7 - DNA, 19 bp, Artificial Sequence
  Synthetic oligonucleotide
tttgtgctgattccatggc

SEQ ID NO: 8 - DNA, 19 bp, Artificial Sequence
  Synthetic oligonucleotide
gacggtgttaatgatagcc

SEQ ID NO: 9 - DNA, 19 bp, Artificial Sequence
  Synthetic oligonucleotide
cttcggcactcctgagttc

SEQ ID NO: 10 - DNA, 19 bp, Artificial Sequence
  Synthetic oligonucleotide
gcacagtttgagaagcagc

SEQ ID NO: 11 - DNA, 19 bp, Artificial Sequence
  Synthetic oligonucleotide
acgcaaagtggccaggagc

SEQ ID NO: 12 - DNA, 19 bp, Artificial Sequence
  Synthetic oligonucleotide
cgatgtgccttcaagattc

SEQ ID NO: 13 - DNA, 19 bp, Artificial Sequence
  Synthetic oligonucleotide
gtgcacggattcagagagc

SEQ ID NO: 14 - DNA, 19 bp, Artificial Sequence
  Synthetic oligonucleotide
cttctacacgtccatgctc

SEQ ID NO: 15 - DNA, 19 bp, Artificial Sequence
  Synthetic oligonucleotide
caacctgctggtgctcgtc

SEQ ID NO: 16 - DNA, 19 bp, Artificial Sequence
  Synthetic oligonucleotide
ctctcttagatctggaacc

SEQ ID NO: 17 - DNA, 19 bp, Artificial Sequence
  Synthetic oligonucleotide
agcaggaaggcggacatac

SEQ ID NO: 18 - DNA, 19 bp, Artificial Sequence
  Synthetic oligonucleotide
ctccagctgagtgagcagc

SEQ ID NO: 19 - DNA, 19 bp, Artificial Sequence
  Synthetic oligonucleotide
taaaccagcagaggagctc

SEQ ID NO: 20 - DNA, 19 bp, Artificial Sequence
  Synthetic oligonucleotide
tcaggtagttggttctgac

SEQ ID NO: 21 - DNA, 19 bp, Artificial Sequence
  Synthetic oligonucleotide
ctgcgccgaacaaatgtac

SEQ ID NO: 22 - DNA, 19 bp, Artificial Sequence
  Synthetic oligonucleotide
tgtggcgacttgtgcacac

SEQ ID NO: 23 - DNA, 19 bp, Artificial Sequence
  Synthetic oligonucleotide
tctctcagtgtagaatgcc

SEQ ID NO: 24 - DNA, 19 bp, Artificial Sequence
  Synthetic oligonucleotide
ccaggaggtgaaaccacac

SEQ ID NO: 25 - DNA, 19 bp, Artificial Sequence
  Synthetic oligonucleotide
tcaggcgactactttactc

SEQ ID NO: 26 - DNA, 19 bp, Artificial Sequence
  Synthetic oligonucleotide
gtgtactggtacaaggacc

SEQ ID NO: 27 - DNA, 19 bp, Artificial Sequence
  Synthetic oligonucleotide
gagcaggtttccaaaggac

SEQ ID NO: 28 - DNA, 19 bp, Artificial Sequence
  Synthetic oligonucleotide
tctctcatcaatactggtc

SEQ ID NO: 29 - DNA, 19 bp, Artificial Sequence
  Synthetic oligonucleotide
tgcagagcagacaagtggc

SEQ ID NO: 30 - DNA, 19 bp, Artificial Sequence
  Synthetic oligonucleotide
tcatgttgaccaagcaagc

SEQ ID NO: 31 - DNA, 19 bp, Artificial Sequence
  Synthetic oligonucleotide
ctatgccatcaccttctgc

SEQ ID NO: 32 - DNA, 19 bp, Artificial Sequence
  Synthetic oligonucleotide
tgtgccgaaggatgtaagc

SEQ ID NO: 33 - DNA, 19 bp, Artificial Sequence
  Synthetic oligonucleotide
ccgggacataactaaatcc

SEQ ID NO: 34 - DNA, 19 bp, Artificial Sequence
  Synthetic oligonucleotide
agcaggctatgggatcaac

SEQ ID NO: 35 - DNA, 19 bp, Artificial Sequence
  Synthetic oligonucleotide
ccacaaggttgcagcattc

SEQ ID NO: 36 - DNA, 19 bp, Artificial Sequence
  Synthetic oligonucleotide
gggctcagccaggagattc

SEQ ID NO: 37 - DNA, 19 bp, Artificial Sequence
  Synthetic oligonucleotide
caggtagacatggcggcac

SEQ ID NO: 38 - DNA, 19 bp, Artificial Sequence
  Synthetic oligonucleotide
ctctccaggacactgactc

SEQ ID NO: 39 - DNA, 19 bp, Artificial Sequence
  Synthetic oligonucleotide
gcacgatttggaggtcgcc

SEQ ID NO: 40 - DNA, 19 bp, Artificial Sequence
  Synthetic oligonucleotide
cgctctggagtctctctcc

SEQ ID NO: 41 - DNA, 19 bp, Artificial Sequence
  Synthetic oligonucleotide
ccccaactacacggagttc

SEQ ID NO: 42 - DNA, 19 bp, Artificial Sequence
  Synthetic oligonucleotide
ggactctcagttcagcatc

SEQ ID NO: 43 - DNA, 19 bp, Artificial Sequence
  Synthetic oligonucleotide
ctttgcgatacatgagccc

SEQ ID NO: 44 - DNA, 19 bp, Artificial Sequence
  Synthetic oligonucleotide
cttcctgaagaccaggttc

SEQ ID NO: 45 - DNA, 19 bp, Artificial Sequence
  Synthetic oligonucleotide
gaatgctggcaacaagacc

SEQ ID NO: 46 - DNA, 19 bp, Artificial Sequence
  Synthetic oligonucleotide
gaagatgtcaacgcccatc

SEQ ID NO: 47 - DNA, 19 bp, Artificial Sequence
  Synthetic oligonucleotide
ttctacgcaccagaactcc

SEQ ID NO: 48 - DNA, 19 bp, Artificial Sequence
  Synthetic oligonucleotide
tgacggttgcatttgccac

SEQ ID NO: 49 - DNA, 19 bp, Artificial Sequence
  Synthetic oligonucleotide
ccagacctcgagcaactcc

SEQ ID NO: 50 - DNA, 19 bp, Artificial Sequence
  Synthetic oligonucleotide
ggagtgcaatctggtttac

SEQ ID NO: 51 - DNA, 19 bp, Artificial Sequence
  Synthetic oligonucleotide
cagtcagtgcaacagtgtc

SEQ ID NO: 52 - DNA, 19 bp, Artificial Sequence
  Synthetic oligonucleotide
cgtgcttgtcatgttcggc

SEQ ID NO: 53 - DNA, 19 bp, Artificial Sequence
  Synthetic oligonucleotide
tgacaggttccgtctgggc

SEQ ID NO: 54 - DNA, 19 bp, Artificial Sequence
  Synthetic oligonucleotide
gtacctgcggcagttgttc

SEQ ID NO: 55 - DNA, 19 bp, Artificial Sequence
  Synthetic oligonucleotide
gaccatcaccatcctggcc

SEQ ID NO: 56 - DNA, 19 bp, Artificial Sequence
  Synthetic oligonucleotide
gcaggcagaggacagattc

SEQ ID NO: 57 - DNA, 19 bp, Artificial Sequence
  Synthetic oligonucleotide
caaagccatgcccgtaagc

SEQ ID NO: 58 - DNA, 19 bp, Artificial Sequence
  Synthetic oligonucleotide
aagtgccctggccttcttc

SEQ ID NO: 59 - DNA, 19 bp, Artificial Sequence
  Synthetic oligonucleotide
ctaccacaagcaggtgtcc

SEQ ID NO: 60 - DNA, 19 bp, Artificial Sequence
  Synthetic oligonucleotide
tgcgtgcttctttgtgggc

SEQ ID NO: 61 - DNA, 19 bp, Artificial Sequence
  Synthetic oligonucleotide
ctacgtcatcctgtgcctc

SEQ ID NO: 62 - DNA, 19 bp, Artificial Sequence
  Synthetic oligonucleotide
ttcggacacccacaaatgc

SEQ ID NO: 63 - DNA, 19 bp, Artificial Sequence
  Synthetic oligonucleotide
gttgtcctgttctgacgtc

SEQ ID NO: 64 - DNA, 19 bp, Artificial Sequence
  Synthetic oligonucleotide
gcaggctttcgagtatggc

SEQ ID NO: 65 - DNA, 19 bp, Artificial Sequence
  Synthetic oligonucleotide
cctctctgtcaacacatgc

SEQ ID NO: 66 - DNA, 19 bp, Artificial Sequence
  Synthetic oligonucleotide
atgacgctacgcaagaacc

SEQ ID NO: 67 - DNA, 19 bp, Artificial Sequence
  Synthetic oligonucleotide
agcgggtgcttacattgcc

SEQ ID NO: 68 - DNA, 19 bp, Artificial Sequence
  Synthetic oligonucleotide
gcaagaatgcacagagagc

SEQ ID NO: 69 - DNA, 19 bp, Artificial Sequence
  Synthetic oligonucleotide
tttgtgctgacagctgctc

SEQ ID NO: 70 - DNA, 19 bp, Artificial Sequence
  Synthetic oligonucleotide
cacctgctttctcaatgcc

SEQ ID NO: 71 - DNA, 19 bp, Artificial Sequence
  Synthetic oligonucleotide
ggttctctgactcgaacac

SEQ ID NO: 72 - DNA, 19 bp, Artificial Sequence
  Synthetic oligonucleotide
agcacctcgctgacattcc

SEQ ID NO: 73 - DNA, 19 bp, Artificial Sequence
  Synthetic oligonucleotide
cctgggcaacacctgctac

SEQ ID NO: 74 - DNA, 19 bp, Artificial Sequence
  Synthetic oligonucleotide
cttaaggtggacctgtggc

SEQ ID NO: 75 - DNA, 19 bp, Artificial Sequence
  Synthetic oligonucleotide
ttgcacagaaaggaggtgc

SEQ ID NO: 76 - DNA, 19 bp, Artificial Sequence
  Synthetic oligonucleotide
gcccgcagtcttacacaac

SEQ ID NO: 77 - DNA, 19 bp, Artificial Sequence
  Synthetic oligonucleotide
gcttctggtggagaaggac

SEQ ID NO: 78 - DNA, 19 bp, Artificial Sequence
  Synthetic oligonucleotide
gtgtatgaagtggtccacc

SEQ ID NO: 79 - DNA, 19 bp, Artificial Sequence
  Synthetic oligonucleotide
gaaatctcactgcttcgac

SEQ ID NO: 80 - DNA, 19 bp, Artificial Sequence
  Synthetic oligonucleotide
cactttataagcctgcggc

SEQ ID NO: 81 - DNA, 19 bp, Artificial Sequence
  Synthetic oligonucleotide
tgggcatcctggctgtaac

SEQ ID NO: 82 - DNA, 19 bp, Artificial Sequence
  Synthetic oligonucleotide
atagactgcagaatgagcc

SEQ ID NO: 83 - DNA, 19 bp, Artificial Sequence
  Synthetic oligonucleotide
cagtgccaagaaggagccc

SEQ ID NO: 84 - DNA, 19 bp, Artificial Sequence
  Synthetic oligonucleotide
tgtgctcgaaggaggaatc

SEQ ID NO: 85 - DNA, 19 bp, Artificial Sequence
  Synthetic oligonucleotide
atgtatggattccagcacc

SEQ ID NO: 86 - DNA, 19 bp, Artificial Sequence
  Synthetic oligonucleotide
gctctgctatgtgtcagtc

SEQ ID NO: 87 - DNA, 19 bp, Artificial Sequence
  Synthetic oligonucleotide
tgtgactaagctggaagac

SEQ ID NO: 88 - DNA, 19 bp, Artificial Sequence
  Synthetic oligonucleotide
tgcgcacaatactggccac

SEQ ID NO: 89 - DNA, 19 bp, Artificial Sequence
  Synthetic oligonucleotide
ttcccgctaccagacctac

SEQ ID NO: 90 - DNA, 19 bp, Artificial Sequence
  Synthetic oligonucleotide
agcatggtcattcacatcc

SEQ ID NO: 91 - DNA, 19 bp, Artificial Sequence
  Synthetic oligonucleotide
atgcaggtccatatgtgac

SEQ ID NO: 92 - DNA, 19 bp, Artificial Sequence
  Synthetic oligonucleotide
cctttctctgaacacggac

SEQ ID NO: 93 - DNA, 19 bp, Artificial Sequence
  Synthetic oligonucleotide
gtcaggctgaatgaggagc

SEQ ID NO: 94 - DNA, 19 bp, Artificial Sequence
  Synthetic oligonucleotide
caggttctcctcaaacggc

SEQ ID NO: 95 - DNA, 19 bp, Artificial Sequence
  Synthetic oligonucleotide
gcataggagtggtcatatc

SEQ ID NO: 96 - DNA, 19 bp, Artificial Sequence
  Synthetic oligonucleotide
acatcctgctgtcagagcc

SEQ ID NO: 97 - DNA, 19 bp, Artificial Sequence
  Synthetic oligonucleotide
catggagttcagcaagatc

SEQ ID NO: 98 - DNA, 19 bp, Artificial Sequence
  Synthetic oligonucleotide
gttctccagtgccattggc

SEQ ID NO: 99 - DNA, 19 bp, Artificial Sequence
  Synthetic oligonucleotide
ttcggcctggacgtctatc

SEQ ID NO: 100 - DNA, 19 bp, Artificial Sequence
  Synthetic oligonucleotide
gtgcattggtgaaagagac

SEQ ID NO: 101 - DNA, 19 bp, Artificial Sequence
  Synthetic oligonucleotide
tgtgcaggataattgctgc

SEQ ID NO: 102 - DNA, 19 bp, Artificial Sequence
  Synthetic oligonucleotide
aggtgtcactgtacagtcc

SEQ ID NO: 103 - DNA, 19 bp, Artificial Sequence
  Synthetic oligonucleotide
agtgcgcatcttcggcctc

SEQ ID NO: 104 - DNA, 19 bp, Artificial Sequence
  Synthetic oligonucleotide
tttgtggactcctacgatc

SEQ ID NO: 105 - DNA, 19 bp, Artificial Sequence
  Synthetic oligonucleotide
gccctgatgtccatcttcc

SEQ ID NO: 106 - DNA, 19 bp, Artificial Sequence
  Synthetic oligonucleotide
catagggaaggacacttgc

SEQ ID NO: 107 - DNA, 19 bp, Artificial Sequence
  Synthetic oligonucleotide
cctggatgtgagagagagc

SEQ ID NO: 108 - DNA, 19 bp, Artificial Sequence
  Synthetic oligonucleotide
aacttgtactatgaaggcc

SEQ ID NO: 109 - DNA, 19 bp, Artificial Sequence
  Synthetic oligonucleotide
gtattctgtacaccctggc

SEQ ID NO: 110 - DNA, 19 bp, Artificial Sequence
  Synthetic oligonucleotide
ttctcgcaatggccaatgc

SEQ ID NO: 111 - DNA, 19 bp, Artificial Sequence
  Synthetic oligonucleotide
gaagaacagcagcctggac

SEQ ID NO: 112 - DNA, 19 bp, Artificial Sequence
  Synthetic oligonucleotide
tcaggcggatcttgacagc

SEQ ID NO: 113 - DNA, 19 bp, Artificial Sequence
  Synthetic oligonucleotide
ttcggcactggtttccctc

SEQ ID NO: 114 - DNA, 19 bp, Artificial Sequence
  Synthetic oligonucleotide
gacgaatatcagctctgcc

SEQ ID NO: 115 - DNA, 19 bp, Artificial Sequence
  Synthetic oligonucleotide
cctctctacgccatctacc

SEQ ID NO: 116 - DNA, 19 bp, Artificial Sequence
  Synthetic oligonucleotide
tctctccacacaaaccttc

SEQ ID NO: 117 - DNA, 19 bp, Artificial Sequence
  Synthetic oligonucleotide
ggtcgggaggagaacagtc

SEQ ID NO: 118 - DNA, 19 bp, Artificial Sequence
  Synthetic oligonucleotide
gcgaattccaccagcattc

SEQ ID NO: 119 - DNA, 19 bp, Artificial Sequence
  Synthetic oligonucleotide
tgtccaggacctattgagc

SEQ ID NO: 120 - DNA, 19 bp, Artificial Sequence
  Synthetic oligonucleotide
tgaccatctgcatgatgtc

SEQ ID NO: 121 - DNA, 19 bp, Artificial Sequence
  Synthetic oligonucleotide
gcatggcatagttggattc

SEQ ID NO: 122 - DNA, 19 bp, Artificial Sequence
  Synthetic oligonucleotide
atgcaggacatgaacaacc

SEQ ID NO: 123 - DNA, 19 bp, Artificial Sequence
  Synthetic oligonucleotide
atgtgtgaatgtgggttgc

SEQ ID NO: 124 - DNA, 19 bp, Artificial Sequence
  Synthetic oligonucleotide
tgcaggctattctgtgagc

SEQ ID NO: 125 - DNA, 19 bp, Artificial Sequence
  Synthetic oligonucleotide
tcggcacaacaatctagac

SEQ ID NO: 126 - DNA, 19 bp, Artificial Sequence
  Synthetic oligonucleotide
gacaggtggacagagcatc

SEQ ID NO: 127 - DNA, 19 bp, Artificial Sequence
  Synthetic oligonucleotide
tgtgcgagacctcgatttc

SEQ ID NO: 128 - DNA, 19 bp, Artificial Sequence
  Synthetic oligonucleotide
agtttgtgtaggtatcgcc

SEQ ID NO: 129 - DNA, 19 bp, Artificial Sequence
  Synthetic oligonucleotide
agcatgaaagaaaccctgc

SEQ ID NO: 130 - DNA, 19 bp, Artificial Sequence
  Synthetic oligonucleotide
gaagatcaccattgctgac

SEQ ID NO: 131 - DNA, 19 bp, Artificial Sequence
  Synthetic oligonucleotide
gcatgaatattgtggaggc

SEQ ID NO: 132 - DNA, 19 bp, Artificial Sequence
  Synthetic oligonucleotide
tgcaggcaagcagacggtc

SEQ ID NO: 133 - DNA, 19 bp, Artificial Sequence
  Synthetic oligonucleotide
tgacgcagatgatgaatcc

SEQ ID NO: 134 - DNA, 19 bp, Artificial Sequence
  Synthetic oligonucleotide
tggcgccatgtcagagtgc

SEQ ID NO: 135 - DNA, 19 bp, Artificial Sequence
  Synthetic oligonucleotide
cttattgttcacattggcc

SEQ ID NO: 136 - DNA, 19 bp, Artificial Sequence
  Synthetic oligonucleotide
tggcacctatgagaggatc

SEQ ID NO: 137 - DNA, 19 bp, Artificial Sequence
  Synthetic oligonucleotide
tcaggtgtcccattccagc

SEQ ID NO: 138 - DNA, 19 bp, Artificial Sequence
  Synthetic oligonucleotide
ctcagaggtggtggaagac

SEQ ID NO: 139 - DNA, 19 bp, Artificial Sequence
  Synthetic oligonucleotide
tgcaggaggaaattgatgc

SEQ ID NO: 140 - DNA, 19 bp, Artificial Sequence
  Synthetic oligonucleotide
gagtccagccttcatgccc

SEQ ID NO: 141 - DNA, 19 bp, Artificial Sequence
  Synthetic oligonucleotide
gtccagctgaagaagatcc

SEQ ID NO: 142 - DNA, 19 bp, Artificial Sequence
  Synthetic oligonucleotide
ttcggcactgaggtcttgc

SEQ ID NO: 143 - DNA, 19 bp, Artificial Sequence
  Synthetic oligonucleotide
ttgcacactgagctggagc

SEQ ID NO: 144 - DNA, 19 bp, Artificial Sequence
  Synthetic oligonucleotide
cctgctcttgagcaataac

SEQ ID NO: 145 - DNA, 19 bp, Artificial Sequence
  Synthetic oligonucleotide
tgtccagaccacatggagc

SEQ ID NO: 146 - DNA, 19 bp, Artificial Sequence
  Synthetic oligonucleotide
ttgcaggaggacaagatgc

SEQ ID NO: 147 - DNA, 19 bp, Artificial Sequence
  Synthetic oligonucleotide
gattgtggccaagaagtac

SEQ ID NO: 148 - DNA, 19 bp, Artificial Sequence
  Synthetic oligonucleotide
cctcattatcaccatgctc

SEQ ID NO: 149 - DNA, 19 bp, Artificial Sequence
  Synthetic oligonucleotide
ctggttattggcgggtatc

SEQ ID NO: 150 - DNA, 19 bp, Artificial Sequence
  Synthetic oligonucleotide
tttgtgcttcaccaagtgc

SEQ ID NO: 151 - DNA, 19 bp, Artificial Sequence
  Synthetic oligonucleotide
ctgcacagtcaacacggtc

SEQ ID NO: 152 - DNA, 19 bp, Artificial Sequence
  Synthetic oligonucleotide
gcagagccaaatatcagcc

SEQ ID NO: 153 - DNA, 19 bp, Artificial Sequence
  Synthetic oligonucleotide
gttcaagaagctgcgccac

SEQ ID NO: 154 - DNA, 19 bp, Artificial Sequence
  Synthetic oligonucleotide
cgtcttcatcagcgtgcac

SEQ ID NO: 155 - DNA, 19 bp, Artificial Sequence
  Synthetic oligonucleotide
gcagttccaagcttgcatc

SEQ ID NO: 156 - DNA, 19 bp, Artificial Sequence
  Synthetic oligonucleotide
gtacctgcgccacttcttc

SEQ ID NO: 157 - DNA, 19 bp, Artificial Sequence
  Synthetic oligonucleotide
gaccatcactatcctggcc

SEQ ID NO: 158 - DNA, 19 bp, Artificial Sequence
  Synthetic oligonucleotide
gtccttctacatcaatgcc

SEQ ID NO: 159 - DNA, 19 bp, Artificial Sequence
  Synthetic oligonucleotide
gaagaagcaactgggagcc

SEQ ID NO: 160 - DNA, 19 bp, Artificial Sequence
  Synthetic oligonucleotide
gttccagaccttcatgtgc

SEQ ID NO: 161 - DNA, 19 bp, Artificial Sequence
  Synthetic oligonucleotide
ctggaccgagctgcttgac

SEQ ID NO: 162 - DNA, 19 bp, Artificial Sequence
  Synthetic oligonucleotide
gcagagcatgggcttaagc

SEQ ID NO: 163 - DNA, 19 bp, Artificial Sequence
  Synthetic oligonucleotide
agcaggcggaacatgttcc

SEQ ID NO: 164 - DNA, 19 bp, Artificial Sequence
  Synthetic oligonucleotide
caacctgttcatccttaac

SEQ ID NO: 165 - DNA, 19 bp, Artificial Sequence
  Synthetic oligonucleotide
atttggtgacacggctgac

SEQ ID NO: 166 - DNA, 19 bp, Artificial Sequence
  Synthetic oligonucleotide
catatggctcttcaagtac

SEQ ID NO: 167 - DNA, 19 bp, Artificial Sequence
  Synthetic oligonucleotide
tggcacagtaacagctgcc

SEQ ID NO: 168 - DNA, 19 bp, Artificial Sequence
  Synthetic oligonucleotide
gttctctcagcacgttcgc

SEQ ID NO: 169 - DNA, 19 bp, Artificial Sequence
  Synthetic oligonucleotide
tgcagacttcagtgcagcc

SEQ ID NO: 170 - DNA, 19 bp, Artificial Sequence
  Synthetic oligonucleotide
ctttctggaaatcctgccc

SEQ ID NO: 171 - DNA, 19 bp, Artificial Sequence
  Synthetic oligonucleotide
caacacagcagacacagtc

SEQ ID NO: 172 - DNA, 19 bp, Artificial Sequence
  Synthetic oligonucleotide
tgggaccagtgactgcagc

SEQ ID NO: 173 - DNA, 19 bp, Artificial Sequence
  Synthetic oligonucleotide
agccagaggagtttgtggc

SEQ ID NO: 174 - DNA, 19 bp, Artificial Sequence
  Synthetic oligonucleotide
ctcgcaggaaattctggac

SEQ ID NO: 175 - DNA, 19 bp, Artificial Sequence
  Synthetic oligonucleotide
atgcaggtcaggttgtttc

SEQ ID NO: 176 - DNA, 19 bp, Artificial Sequence
  Synthetic oligonucleotide
atcaggccttacatccagc

SEQ ID NO: 177 - DNA, 19 bp, Artificial Sequence
  Synthetic oligonucleotide
ctgtgggagaaacagagac

SEQ ID NO: 178 - DNA, 19 bp, Artificial Sequence
  Synthetic oligonucleotide
ctctgcgactactacctgc

SEQ ID NO: 179 - DNA, 19 bp, Artificial Sequence
  Synthetic oligonucleotide
ctgatgaaggccttcgacc

SEQ ID NO: 180 - DNA, 19 bp, Artificial Sequence
  Synthetic oligonucleotide
accgtggaaggcctatcgc

SEQ ID NO: 181 - DNA, 19 bp, Artificial Sequence
  Synthetic oligonucleotide
ttccagctgatatatccac

SEQ ID NO: 182 - DNA, 19 bp, Artificial Sequence
  Synthetic oligonucleotide
gccagacactgacaagttc

SEQ ID NO: 183 - DNA, 19 bp, Artificial Sequence
  Synthetic oligonucleotide
tcggcagggccagcatttc

SEQ ID NO: 184 - DNA, 19 bp, Artificial Sequence
  Synthetic oligonucleotide
gtcttcgaccctcaggaac

SEQ ID NO: 185 - DNA, 19 bp, Artificial Sequence
  Synthetic oligonucleotide
tcagaaggttgtgcaggac

SEQ ID NO: 186 - DNA, 19 bp, Artificial Sequence
  Synthetic oligonucleotide
caacttgcatgactacggc

SEQ ID NO: 187 - DNA, 19 bp, Artificial Sequence
  Synthetic oligonucleotide
tgtgcaagaggttcgttgc

SEQ ID NO: 188 - DNA, 19 bp, Artificial Sequence
  Synthetic oligonucleotide
accagtggtaaatgtcagc

SEQ ID NO: 189 - DNA, 19 bp, Artificial Sequence
  Synthetic oligonucleotide
ctctgtatcccattccctc

SEQ ID NO: 190 - DNA, 19 bp, Artificial Sequence
  Synthetic oligonucleotide
cttcttgaagcatctatgc

SEQ ID NO: 191 - DNA, 19 bp, Artificial Sequence
  Synthetic oligonucleotide
catgctgttgtcctttacc

SEQ ID NO: 192 - DNA, 19 bp, Artificial Sequence
  Synthetic oligonucleotide
cgaagatgttgacctggtc

SEQ ID NO: 193 - DNA, 19 bp, Artificial Sequence
  Synthetic oligonucleotide
tgtcctgttggatgcacac

SEQ ID NO: 194 - DNA, 19 bp, Artificial Sequence
  Synthetic oligonucleotide
atgcagaccctggaccaac

SEQ ID NO: 195 - DNA, 19 bp, Artificial Sequence
  Synthetic oligonucleotide
gtagcactctgcgacatgc

SEQ ID NO: 196 - DNA, 19 bp, Artificial Sequence
  Synthetic oligonucleotide
ctggaatgggatccgacac

SEQ ID NO: 197 - DNA, 19 bp, Artificial Sequence
  Synthetic oligonucleotide
gttattcttccaccatggc

SEQ ID NO: 198 - DNA, 19 bp, Artificial Sequence
  Synthetic oligonucleotide
tgccagcagtctcttgatc

SEQ ID NO: 199 - DNA, 19 bp, Artificial Sequence
  Synthetic oligonucleotide
gatcttccggcccaaacac

SEQ ID NO: 200 - DNA, 19 bp, Artificial Sequence
  Synthetic oligonucleotide
agcatgacaggaaacctgc

SEQ ID NO: 201 - DNA, 19 bp, Artificial Sequence
  Synthetic oligonucleotide
tcttctctgtgaacatacc

SEQ ID NO: 202 - DNA, 19 bp, Artificial Sequence
  Synthetic oligonucleotide
ccttgttggccaatgattc

SEQ ID NO: 203 - DNA, 19 bp, Artificial Sequence
  Synthetic oligonucleotide
ccaggtttgtcaacgtgac

SEQ ID NO: 204 - DNA, 19 bp, Artificial Sequence
  Synthetic oligonucleotide
ttccagctcagtgctaatc

SEQ ID NO: 205 - DNA, 19 bp, Artificial Sequence
  Synthetic oligonucleotide
agcaggaacatctcttcgc

SEQ ID NO: 206 - DNA, 19 bp, Artificial Sequence
  Synthetic oligonucleotide
caagttctcctgcaagttc

SEQ ID NO: 207 - DNA, 19 bp, Artificial Sequence
  Synthetic oligonucleotide
gagcatgaccttcgatggc

SEQ ID NO: 208 - DNA, 19 bp, Artificial Sequence
  Synthetic oligonucleotide
ctggcagaagcagcacaac

SEQ ID NO: 209 - DNA, 19 bp, Artificial Sequence
  Synthetic oligonucleotide
tacctgctgggcatcaagc

SEQ ID NO: 210 - DNA, 19 bp, Artificial Sequence
  Synthetic oligonucleotide
ctggaagtcctgtgtgatc

SEQ ID NO: 211 - DNA, 19 bp, Artificial Sequence
  Synthetic oligonucleotide
ggacaccttcccaaatgtc

SEQ ID NO: 212 - DNA, 19 bp, Artificial Sequence
  Synthetic oligonucleotide
ggcagaaattccagagagc

SEQ ID NO: 213 - DNA, 19 bp, Artificial Sequence
  Synthetic oligonucleotide
caacatcccaactgtggtc

SEQ ID NO: 214 - DNA, 19 bp, Artificial Sequence
  Synthetic oligonucleotide
tatcctgaccttcctgcgc

SEQ ID NO: 215 - DNA, 19 bp, Artificial Sequence
  Synthetic oligonucleotide
tgtttaccagtccgaagcc

SEQ ID NO: 216 - DNA, 19 bp, Artificial Sequence
  Synthetic oligonucleotide
aactgtaccgcagagttcc

SEQ ID NO: 217 - DNA, 19 bp, Artificial Sequence
  Synthetic oligonucleotide
agcatgatgatagttcctc

SEQ ID NO: 218 - DNA, 19 bp, Artificial Sequence
  Synthetic oligonucleotide
caagtgccgtatcatccac

SEQ ID NO: 219 - DNA, 19 bp, Artificial Sequence
  Synthetic oligonucleotide
tattcgtgcggaggaagac

SEQ ID NO: 220 - DNA, 19 bp, Artificial Sequence
  Synthetic oligonucleotide
gtacctgctggtggagttc

SEQ ID NO: 221 - DNA, 20 bp, Artificial Sequence
  Synthetic oligonucleotide
catggcgacctgaaggaaag

SEQ ID NO: 222 - DNA, 23 bp, Artificial Sequence
  Synthetic oligonucleotide
agagaccaaaagaccctggaagt

SEQ ID NO: 223 - DNA, 18 bp, Artificial Sequence
  Synthetic oligonucleotide
acagcggcggcttctaca

SEQ ID NO: 224 - DNA, 21 bp, Artificial Sequence
  Synthetic oligonucleotide
catcggcgtgtttggagtagt

SEQ ID NO: 225 - DNA, 22 bp, Artificial Sequence
  Synthetic oligonucleotide
atccggatcacctgtttgaaac

SEQ ID NO: 226 - DNA, 23 bp, Artificial Sequence
  Synthetic oligonucleotide
gtggtgattttgtccttctcgat

SEQ ID NO: 227 - DNA, 23 bp, Artificial Sequence
  Synthetic oligonucleotide
ccatacacagagggaagcatacg

SEQ ID NO: 228 - DNA, 24 bp, Artificial Sequence
  Synthetic oligonucleotide
cagtcttgctgtgatctgggagta

SEQ ID NO: 229 - DNA, 20 bp, Artificial Sequence
  Synthetic oligonucleotide
gcataggcgatgaggagcat

SEQ ID NO: 230 - DNA, 19 bp, Artificial Sequence
  Synthetic oligonucleotide
gacctcggcctgcattagg

SEQ ID NO: 231 - DNA, 21 bp, Artificial Sequence
  Synthetic oligonucleotide
catcgtcgctctgcaactttt

SEQ ID NO: 232 - DNA, 24 bp, Artificial Sequence
  Synthetic oligonucleotide
ccgctctgtacttctttgaaatga

SEQ ID NO: 233 - DNA, 23 bp, Artificial Sequence
  Synthetic oligonucleotide
cctggtggagaccttgtaaacct

SEQ ID NO: 234 - DNA, 25 bp, Artificial Sequence
  Synthetic oligonucleotide
agcaagaacaacttcagcagtgtaa

SEQ ID NO: 235 - DNA, 22 bp, Artificial Sequence
  Synthetic oligonucleotide
gccatgaccagctttcactaca

SEQ ID NO: 236 - DNA, 21 bp, Artificial Sequence
  Synthetic oligonucleotide
gttaaggcaggccctcaggta

SEQ ID NO: 237 - DNA, 22 bp, Artificial Sequence
  Synthetic oligonucleotide
ctaaccgtgctggcctatgaac

SEQ ID NO: 238 - DNA, 21 bp, Artificial Sequence
  Synthetic oligonucleotide
caggcccaggaaaaattgatc

SEQ ID NO: 239 - DNA, 19 bp, Artificial Sequence
  Synthetic oligonucleotide
ttcgcgatcagccccttac

SEQ ID NO: 240 - DNA, 22 bp, Artificial Sequence
  Synthetic oligonucleotide
actcactggctgaggaggtcat

SEQ ID NO: 241 - DNA, 21 bp, Artificial Sequence
  Synthetic oligonucleotide
ttccagaccattggcttgagt

SEQ ID NO: 242 - DNA, 21 bp, Artificial Sequence
  Synthetic oligonucleotide
actcccactgactttcctgct

SEQ ID NO: 243 - DNA, 25 bp, Artificial Sequence
  Synthetic oligonucleotide
catgctgagtgacacagacaagaag

SEQ ID NO: 244 - DNA, 25 bp, Artificial Sequence
  Synthetic oligonucleotide
tggtagttgttgtgagcatagtcca

SEQ ID NO: 245 - DNA, 21 bp, Artificial Sequence
  Synthetic oligonucleotide
ccgtttacgtggagactcgcc

SEQ ID NO: 246 - DNA, 25 bp, Artificial Sequence
  Synthetic oligonucleotide
cccccaccttatatatattctttcc

SEQ ID NO: 247 - DNA, 19 bp, Artificial Sequence
  Synthetic oligonucleotide
cgttggcagaatcatttac

SEQ ID NO: 248 - DNA, 19 bp, Artificial Sequence
  Synthetic oligonucleotide
ttcgcggatgatgtacttc

SEQ ID NO: 249 - DNA, 19 bp, Artificial Sequence
  Synthetic oligonucleotide
ctctcagtactttaacatc

SEQ ID NO: 250 - DNA, 19 bp, Artificial Sequence
  Synthetic oligonucleotide
cataacaaaggcatcgccc

SEQ ID NO: 251 - DNA, 19 bp, Artificial Sequence
  Synthetic oligonucleotide
ttaatgatagccatccagc

SEQ ID NO: 252 - DNA, 19 bp, Artificial Sequence
  Synthetic oligonucleotide
attccaggccatttatggc

SEQ ID NO: 253 - DNA, 19 bp, Artificial Sequence
  Synthetic oligonucleotide
tgttagactacgtgatgac

SEQ ID NO: 254 - DNA, 19 bp, Artificial Sequence
  Synthetic oligonucleotide
caacctcacctacaggatc

SEQ ID NO: 255 - DNA, 19 bp, Artificial Sequence
  Synthetic oligonucleotide
tctacccgatcaaccacac

SEQ ID NO: 256 - DNA, 19 bp, Artificial Sequence
  Synthetic oligonucleotide
cccttggaggaactatgcc

SEQ ID NO: 257 - DNA, 19 bp, Artificial Sequence
  Synthetic oligonucleotide
caactcagacaactgcatc

SEQ ID NO: 258 - DNA, 19 bp, Artificial Sequence
  Synthetic oligonucleotide
tcattgtaaggctgtggcc

SEQ ID NO: 259 - DNA, 19 bp, Artificial Sequence
  Synthetic oligonucleotide
ggaccaatgggagatagac

SEQ ID NO: 260 - DNA, 19 bp, Artificial Sequence
  Synthetic oligonucleotide
agcttatccagctttatgc

SEQ ID NO: 261 - DNA, 19 bp, Artificial Sequence
  Synthetic oligonucleotide
gtgcattaacaagaagaac

SEQ ID NO: 262 - DNA, 19 bp, Artificial Sequence
  Synthetic oligonucleotide
acctgcagccttcactttc

SEQ ID NO: 263 - DNA, 19 bp, Artificial Sequence
  Synthetic oligonucleotide
tcccttctggatcgactac

SEQ ID NO: 264 - DNA, 19 bp, Artificial Sequence
  Synthetic oligonucleotide
caattatgagtccacggtc

SEQ ID NO: 265 - DNA, 19 bp, Artificial Sequence
  Synthetic oligonucleotide
aacgatgggcatgtatttc

SEQ ID NO: 266 - DNA, 19 bp, Artificial Sequence
  Synthetic oligonucleotide
tgtctcctatgttcaggtc

SEQ ID NO: 267 - DNA, 19 bp, Artificial Sequence
  Synthetic oligonucleotide
gtatggacagaactggctc

SEQ ID NO: 268 - DNA, 19 bp, Artificial Sequence
  Synthetic oligonucleotide
gatgaacatgtatggagac

SEQ ID NO: 269 - DNA, 19 bp, Artificial Sequence
  Synthetic oligonucleotide
attccttcaaacgtatggc

SEQ ID NO: 270 - DNA, 19 bp, Artificial Sequence
  Synthetic oligonucleotide
gctcctggagaacatgtac

SEQ ID NO: 271 - DNA, 19 bp, Artificial Sequence
  Synthetic oligonucleotide
accaacctcagaggttctc

SEQ ID NO: 272 - DNA, 19 bp, Artificial Sequence
  Synthetic oligonucleotide
aagcggacctacaaacttc

SEQ ID NO: 273 - DNA, 19 bp, Artificial Sequence
  Synthetic oligonucleotide
cgtctacatgtacgtgttc

SEQ ID NO: 274 - DNA, 19 bp, Artificial Sequence
  Synthetic oligonucleotide
gtgtgtacatcaactgttc

SEQ ID NO: 275 - DNA, 19 bp, Artificial Sequence
  Synthetic oligonucleotide
ggcacagtccaatctgaac

SEQ ID NO: 276 - DNA, 19 bp, Artificial Sequence
  Synthetic oligonucleotide
cgcaagttctactccatcc

SEQ ID NO: 277 - DNA, 19 bp, Artificial Sequence
  Synthetic oligonucleotide
ggtgttcagtctggacaac

SEQ ID NO: 278 - DNA, 19 bp, Artificial Sequence
  Synthetic oligonucleotide
gtgttcagtctggacaacc

SEQ ID NO: 279 - DNA, 19 bp, Artificial Sequence
  Synthetic oligonucleotide
acttgaactctctccacac

SEQ ID NO: 280 - DNA, 19 bp, Artificial Sequence
  Synthetic oligonucleotide
gtcttcaataacttgaagc

SEQ ID NO: 281 - DNA, 19 bp, Artificial Sequence
  Synthetic oligonucleotide
ccacaacaagcacgtgttc

SEQ ID NO: 282 - DNA, 19 bp, Artificial Sequence
  Synthetic oligonucleotide
atcaatcgaaagattcttc

SEQ ID NO: 283 - DNA, 19 bp, Artificial Sequence
  Synthetic oligonucleotide
cgacgttgacaattccagc

SEQ ID NO: 284 - DNA, 19 bp, Artificial Sequence
  Synthetic oligonucleotide
gcagagttgcagatttgtc

SEQ ID NO: 285 - DNA, 19 bp, Artificial Sequence
  Synthetic oligonucleotide
tcagcattcctacgataac

SEQ ID NO: 286 - DNA, 19 bp, Artificial Sequence
  Synthetic oligonucleotide
ccggcagaaggataacctc

SEQ ID NO: 287 - DNA, 19 bp, Artificial Sequence
  Synthetic oligonucleotide
ccagaactgtgaagtttac

SEQ ID NO: 288 - DNA, 19 bp, Artificial Sequence
  Synthetic oligonucleotide
gcatggcaagaaagttaac

SEQ ID NO: 289 - DNA, 19 bp, Artificial Sequence
  Synthetic oligonucleotide
agcatgttatgccttatgc

SEQ ID NO: 290 - DNA, 19 bp, Artificial Sequence
  Synthetic oligonucleotide
tcattgtttctgccatagc

SEQ ID NO: 291 - DNA, 19 bp, Artificial Sequence
  Synthetic oligonucleotide
gatctttaaccagcctgac

SEQ ID NO: 292 - DNA, 19 bp, Artificial Sequence
  Synthetic oligonucleotide
gcacaccgtggtagtatac

SEQ ID NO: 293 - DNA, 19 bp, Artificial Sequence
  Synthetic oligonucleotide
gtccttccacatcaagaac

SEQ ID NO: 294 - DNA, 19 bp, Artificial Sequence
  Synthetic oligonucleotide
tgcaacctcttacccaagc

SEQ ID NO: 295 - DNA, 19 bp, Artificial Sequence
  Synthetic oligonucleotide
ctcaatcccttcgtctacc

SEQ ID NO: 296 - DNA, 19 bp, Artificial Sequence
  Synthetic oligonucleotide
cgtggtctacgcgttctac

SEQ ID NO: 297 - DNA, 19 bp, Artificial Sequence
  Synthetic oligonucleotide
cattatcaccatgctcggc

SEQ ID NO: 298 - DNA, 19 bp, Artificial Sequence
  Synthetic oligonucleotide
tctctcttcctatcaatcc

SEQ ID NO: 299 - DNA, 19 bp, Artificial Sequence
  Synthetic oligonucleotide
ccaaacgtgtctggaagac

SEQ ID NO: 300 - DNA, 19 bp, Artificial Sequence
  Synthetic oligonucleotide
gtacctgtagccatctaac

SEQ ID NO: 301 - DNA, 19 bp, Artificial Sequence
  Synthetic oligonucleotide
gctagtgaataatgattgc

SEQ ID NO: 302 - DNA, 19 bp, Artificial Sequence
  Synthetic oligonucleotide
acacgactataagtctaac

SEQ ID NO: 303 - DNA, 19 bp, Artificial Sequence
  Synthetic oligonucleotide
acattgcaatggacaacac

SEQ ID NO: 304 - DNA, 19 bp, Artificial Sequence
  Synthetic oligonucleotide
ggaatatcctgagtgttgc

SEQ ID NO: 305 - DNA, 19 bp, Artificial Sequence
  Synthetic oligonucleotide
tgccagagggatgaactac

SEQ ID NO: 306 - DNA, 19 bp, Artificial Sequence
  Synthetic oligonucleotide
atggaagactgctggaatc

SEQ ID NO: 307 - DNA, 19 bp, Artificial Sequence
  Synthetic oligonucleotide
gagcgcttcaaacgagatc

SEQ ID NO: 308 - DNA, 19 bp, Artificial Sequence
  Synthetic oligonucleotide
acctgtccctagattcttc

SEQ ID NO: 309 - DNA, 19 bp, Artificial Sequence
  Synthetic oligonucleotide
acgcatcttggcaaagagc

SEQ ID NO: 310 - DNA, 19 bp, Artificial Sequence
  Synthetic oligonucleotide
attccagggtttatgtgtc

SEQ ID NO: 311 - DNA, 19 bp, Artificial Sequence
  Synthetic oligonucleotide
caacagtgcatctcttatc

SEQ ID NO: 312 - DNA, 19 bp, Artificial Sequence
  Synthetic oligonucleotide
cagcatctacctcctgaac

SEQ ID NO: 313 - DNA, 19 bp, Artificial Sequence
  Synthetic oligonucleotide
cagcgctctcaatcccttc

SEQ ID NO: 314 - DNA, 19 bp, Artificial Sequence
  Synthetic oligonucleotide
catcgactatatagcaggc

SEQ ID NO: 315 - DNA, 19 bp, Artificial Sequence
  Synthetic oligonucleotide
ccaagagtctattcaaagc

SEQ ID NO: 316 - DNA, 19 bp, Artificial Sequence
  Synthetic oligonucleotide
ccactaatgtcaacaatgc

SEQ ID NO: 317 - DNA, 19 bp, Artificial Sequence
  Synthetic oligonucleotide
ccactcgtcagatgtttgc

SEQ ID NO: 318 - DNA, 19 bp, Artificial Sequence
  Synthetic oligonucleotide
ccctgtcattgatggagac

SEQ ID NO: 319 - DNA, 19 bp, Artificial Sequence
  Synthetic oligonucleotide
ccgagccatatacttgacc

SEQ ID NO: 320 - DNA, 19 bp, Artificial Sequence
  Synthetic oligonucleotide
cctagagctgattgagttc

SEQ ID NO: 321 - DNA, 19 bp, Artificial Sequence
  Synthetic oligonucleotide
cctcgacaccaagtcttgc

SEQ ID NO: 322 - DNA, 19 bp, Artificial Sequence
  Synthetic oligonucleotide
cgctctttaacatgaatgc

SEQ ID NO: 323 - DNA, 19 bp, Artificial Sequence
  Synthetic oligonucleotide
cgtggacatggagtacgac

SEQ ID NO: 324 - DNA, 19 bp, Artificial Sequence
  Synthetic oligonucleotide
ctcgtaatgagactatagc

SEQ ID NO: 325 - DNA, 19 bp, Artificial Sequence
  Synthetic oligonucleotide
ctgcaaatcttcaggtttc

SEQ ID NO: 326 - DNA, 19 bp, Artificial Sequence
  Synthetic oligonucleotide
gaagcacgatttggaggtc

SEQ ID NO: 327 - DNA, 19 bp, Artificial Sequence
  Synthetic oligonucleotide
gatgatgaaggagacgttc

SEQ ID NO: 328 - DNA, 19 bp, Artificial Sequence
  Synthetic oligonucleotide
gatttggttataagggttc

SEQ ID NO: 329 - DNA, 19 bp, Artificial Sequence
  Synthetic oligonucleotide
gctactgccctatatgatc

SEQ ID NO: 330 - DNA, 19 bp, Artificial Sequence
  Synthetic oligonucleotide
tccggttctatttgatcgc

SEQ ID NO: 331 - DNA, 19 bp, Artificial Sequence
  Synthetic oligonucleotide
tcgcccttcctattccttc

SEQ ID NO: 332 - DNA, 19 bp, Artificial Sequence
  Synthetic oligonucleotide
tgtacgtgttcatcctggc

SEQ ID NO: 333 - DNA, 19 bp, Artificial Sequence
  Synthetic oligonucleotide
tgtgacattatgcctttgc

SEQ ID NO: 334 - DNA, 12 bp, Artificial Sequence
  Synthetic oligonucleotide
gtttgctataac

SEQ ID NO: 335 - DNA, 1125 bp, Homo sapiens
tttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcc

SEQ ID NO: 336 - DNA, 3800 bp, Homo sapiens
atggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggctggttatgatggtgagagtatcggaaattgcccgttttctcagcgtctctttatgattctctggctgaaaggcgttatatttaatgtgaccacagtggacctgaaaaggaaacccgcagacctgcagaacctggctcccggaacaaaccctcctttcatgacttttgatggtgaagtcaagacggatgtgaataagatcgaggagttcttagaggagaaattagctcccccgaggtatcccaagctggggacccaacatcccgaatctaattccgcaggaaatgacgtgtttgccaaattctcagcgtttataaaaaacacgaagaaggatgcaaatgagattcatgaaaagaacctgctgaaggccctgaggaagctggataattacttaaatagccctctgcctgatgaaatagatgcctacagcaccgaggatgtcactgtttctggaaggaagtttctggatggggacgagctgacgctggctgactgcaacctcttacccaagctccatattattaagattgtggccaagaagtacagagattttgaatttccttctgaaatgactggcatctggagatacttgaataatgcttatgctagagatgagttcacaaatacgtgtccagctgatcaagagattgaacacgcatattcagatgttgcaaaaagaatgaaatgaagctgggctgttttctgtcttatttctcagttgagtgagcaaggatacgaaaacagtgtgtttgaaaacaaattaggtttgggttcaattccttcaatttttaaaaaactggtctctgagagttttttaaatcattgagagcctgtttttcttctctaaaacattagtttaattttcttcaaaatgaaaatactgctttgtaattacaaaatgagacacacctatcttgatattttaaagcaatatcagagggtgtaaagaaggacattttaacaatcgccttcaattttactccacttaattaccgaaaacttactggagaacatgttccaaatcttcagtatcttgttctctctctctctctctctctctctctctatcacacacacacacacacacacacacacacacacacacaatttcattcatatatggtattgcattattttattttaaagcactggtgaggggacctcttggtgattcctggatgatcatacacagaggacttacaccatacaaaaatattgggcaccgcagtgccagagaagatgcttgaggttagattttaaggagtggggaattgtgaagcccacagatgcgcacgcaatgaccagcaggaaccggaagccctgggtcacccccactctgcctcatttctgcctccaggatgccactgcctctgcttccaggaaaggcaagggggagggtgcttatccgtgtctctggttccagcttcctgtctttgctccctcccctctcttagagactgtgccttcagcaggactcttaatatctgctgcaacttggagaacctccctgccctgaaatgtgaaccaagcacactttggttccttctccgggcggctctctctgagacccaaggctgcagtccctcagtgctggtggtatcgtgtggggatagcaatacttctctgcccttcattgtctcatctagacatcaagcagggaaaatccagggagattaaattcatggtgacaagtcctgggcagttctggtaaacggtccagttagggagggagtagaaactattgactcaaaagagtttctggctgatctgtggctttgcctccaccatccctaaccaacctctcatcacagctttgtgtgtgggctgagtgctggccttaaccctaggcgtggaagagaaaatgtgaggttgtttagatactcatcaggacctcacaggagctgagacttatcagccagaatgtgttcttcggacagtcgtacacatcttacagaaaaccctccttgtagagttggttgtggtatgtgtttgatgctataaagctcatttttaatgtgtacacctgctctagggacgattcgtttgaaagagagtaagatgcattaacagaaactatcctgggattaggtgaaaaatgtctagcaaaagaaacaaagtctttaatagagtggcctctttcgctcttcgattatgactgctgcagttttaccccagcagtcagctgtctttgtcaaccatacgtttttggagattgggtctagcacatgtcacccttgtccacgttgtttcacatctggttagggggcagattttaaaatgtagttttgtaatgttacatttaagcatgataaatgattagactaccagatgttactagtgctaactttgtattcttagacattaaaatgattgacataaactctttgtgccttgaaaatgaaacaaattataaaaatgtttaaatgg

SEQ ID NO: 337 - DNA, 2299 bp, Homo sapiens
cctaccggtccatagtgtcagagtggtgaacccctgcagccagcaggcctcctgaaaaaaaagtccatgggtgacagaagattcattgacttccaattccaagattcaaattcaagcctcagacccaggttgggcaatgctactgccaataatacttgcattgttgatgattccttcaagtataatctcaatggtgctgtctacagtgttgtattcatcttgggtctgataaccaacagtgtctctctgtttgtcttctgtttccgcatgaaaatgagaagtgagactgctatttttatcaccaatctagctgtctctgatttgctttttgtctgtacactaccttttaaaatattttacaacttcaaccgccactggccttttggtgacaccctctgcaagatctctggaactgcattccttaccaacatctatgggagcatgctctttctcacctgtattagtgtggatcgtttcctggccattgtctatccttttcgatctcgtactattaggactaggaggaattctgccattgtgtgtgctggtgtctggatcctagtcctcagtggcggtatttcagcctctttgttttccaccactaatgtcaacaatgcaaccaccacctgctttgaaggcttctccaaacgtgtctggaagacttatttatccaagatcacaatatttattgaagttgttgggtttatcattcctctaatattgaatgtctcttgctcttctgtggtgctgagaactcttcgcaagcctgctactctgtctcaaattgggaccaataagaaaaaagtactgaaaatgatcacagtacatatggcagtctttgtggtatgctttgtaccctacaactctgtcctcttcttgtatgccctggtgcgctcccaagctattactaattgctttttggaaagatttgcaaagatcatgtacccaatcaccttgtgccttgcaactctgaactgttgttttgaccctttcatctattacttcacccttgaatcctttcagaagtccttctacatcaatgcccacatcagaatggagtccctgtttaagactgaaacacctttgaccacaaagccttcccttccagctattcaagaggaagtgagtgatcaaacaacaaataatggtggtgaattaatgctagaatccaccttttaggtatgagaaatgtgttcaggtccagatatggtttctcctataatttttcctatgctataaactaaagatttgaagctaatgatactgagaataatgcaccaaatccagtcagatacatttgtttgaaggtatactgtagagtttttattgctgttttgttcagtaattataggtcaaatctaattacaacaaccaagatggattgccaaactcttctgcttggttggaatttcattgtatcgcattatccaggtggctagtggcatttgataatatagagatgactttgaaactttcaaaaaggtatttctattccaatgatatttggtaattaggttgggcctataaatatagaacaaattcagggatttttaaaaaattgtgttactactgatatatgctagttttattttatttttttggactgtcattgagtttattttagcacaagaatatttttagcctaacattattaataagaaatgtgtcaaatttttaacattggtaaaatatgttatgtgcattttgaaaacagaaaacaaattgcgttggcatgtacgtgggtgggaagaaaaagaaaattaacaggatttacacaattataatcaccagcagtgtgagtttaaaaaacttcgttgtttttacaccaaattaaaattttcatgtcaaacttcaaagccagaaagctgctaaatacgtgtctggcaggtaaaagctggaaaattacttaaaacaggaaagtgtcaataaaaaaacttgagcaacaccaacatattttttcttaaaatgtcacgttatcttcattttgggaaactaggttctataaaatatttatcctccctgttatactttggagcacagcacagccagaaaggggctgcatttgtgcccaggtcaggagcaaattgaaaaaaaaaataaagtaatactaaaaaatcaaactataaacccaaaacatttattaaaacctgaattaatcctttttggagggaggagtagagatatataacctgaaaatacttattctttcttatcgaattttggagcctaatatagccaggagctgctgaatttgtgcccctggattggaaccaaataaaaaaaaaaaaaaaaaattcct

SEQ ID NO: 338 - DNA, 4665 bp, Homo sapiens
agccagcccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggtcatggtttgacaaacagagtgagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaaga

SEQ ID NO: 339 - DNA, 6293 bp, Homo sapiens
atcatgggaccgggtgagcgctgagaatcgcggccgcagccatcagccctggagatgaccaggagcggccactgctgagaactatgtggagagaggctgcgagccctgctgcagagcctccggctgggatagccgccccccgtgggggcgatgcggacagcgcgggacagccaggggagcgcgctggggccgcagcatgcgggaacccgctaaacccggtggctgctgaggcggccgagatgctcgtgcgcgcagcgcgccccactgcatcctcgaccttctcgggctacagggaccgtcagtggcgactatgggcagagtgggctattggaccctgctggtgctgccggcccttctggtctggcgcggtccggcgccgagcgcggcggcggagaagggtccccccgcgctaaatattgcggtgatgctgggtcacagccacgacgtgacagagcgcgaacttcgaacactgtggggccccgagcaggcggcggggctgcccctggacgtgaacgtggtagctctgctgatgaaccgcaccgaccccaagagcctcatcacgcacgtgtgcgacctcatgtccggggcacgcatccacggcctcgtgtttggggacgacacggaccaggaggccgtagcccagatgctggattttatctcctcccacaccttcgtccccatcttgggcattcatgggggcgcatctatgatcatggctgacaaggatccgacgtctaccttcttccagtttggagcgtccatccagcagcaagccacggtcatgctgaagatcatgcaggattatgactggcatgtcttctccctggtgaccactatcttccctggctacagggaattcatcagcttcgtcaagaccacagtggacaacagctttgtgggctgggacatgcagaatgtgatcacactggacacttcctttgaggatgcaaagacacaagtccagctgaagaagatccactcttctgtcatcttgctctactgttccaaagacgaggctgttctcattctgagtgaggcccgctcccttggcctcaccgggtatgatttcttctggattgtccccagcttggtctctgggaacacggagctcatcccaaaagagtttccatcgggactcatttctgtctcctacgatgactgggactacagcctggaggcgagagtgagggacggcattggcatcctaaccaccgctgcatcttctatgctggagaagttctcctacatccccgaggccaaggccagctgctacgggcagatggagaggccagaggtcccgatgcacaccttgcacccatttatggtcaatgttacatgggatggcaaagacttatccttcactgaggaaggctaccaggtgcaccccaggctggtggtgattgtgctgaacaaagaccgggaatgggaaaaggtgggcaagtgggagaaccatacgctgagcctgaggcacgccgtgtggcccaggtacaagtccttctccgactgtgagccggatgacaaccatctcagcatcgtcaccctggaggaggccccattcgtcatcgtggaagacatagaccccctgaccgagacgtgtgtgaggaacaccgtgccatgtcggaagttcgtcaaaatcaacaattcaaccaatgaggggatgaatgtgaagaaatgctgcaaggggttctgcattgatattctgaagaagctttccagaactgtgaagtttacttacgacctctatctggtgaccaatgggaagcatggcaagaaagttaacaatgtgtggaatggaatgatcggtgaagtggtctatcaacgggcagtcatggcagttggctcgctcaccatcaatgaggaacgttctgaagtggtggacttctctgtgccctttgtggaaacgggaatcagtgtcatggtttcaagaagtaatggcaccgtctcaccttctgcttttctagaaccattcagcgcctctgtctgggtgatgatgtttgtgatgctgctcattgtttctgccatagctgtttttgtctttgaatacttcagccctgttggatacaacagaaacttagccaaagggaaagcaccccatgggccttcttttacaattggaaaagctatatggcttctttggggcctggtgttcaataactccgtgcctgtccagaatcctaaagggaccaccagcaagatcatggtatctgtatgggccttcttcgctgtcatattcctggctagctacacagccaatctggctgccttcatgatccaagaggaatttgtggaccaagtgaccggcctcagtgacaaaaagtttcagagacctcatgactattccccaccttttcgatttgggacagtgcctaatggaagcacggagagaaacattcggaataactatccctacatgcatcagtacatgaccaaatttaatcagaaaggagtagaggacgccttggtcagcctgaaaacggggaagctggacgctttcatctacgatgccgcagtcttgaattacaaggctgggagggatgaaggctgcaagctggtgaccatcgggagtgggtacatctttgccaccaccggttatggaattgcccttcagaaaggctctccttggaagaggcagatcgacctggccttgcttcagtttgtgggtgatggtgagatggaggagctggagaccctgtggctcactgggatctgccacaacgagaagaacgaggtgatgagcagccagctggacattgacaacatggcgggcgtattctacatgctggctgccgccatggcccttagcctcatcaccttcatctgggagcacctcttctactggaagctgcgcttctgtttcacgggcgtgtgctccgaccggcctgggttgctcttctccatcagcaggggcatctacagctgcattcatggagtgcacattgaagaaaagaagaagtctccagacttcaatctgacgggatcccagagcaacatgttaaaactcctccggtcagccaaaaacatttccagcatgtccaacatgaactcctcaagaatggactcacccaaaagagctgctgacttcatccaaagaggttccctcatcatggacatggtttcagataaggggaatttgatgtactcagacaacaggtcctttcaggggaaagagagcatttttggagacaacatgaacgaactccaaacatttgtggccaaccggcagaaggataacctcaataactatgtattccagggacaacatcctcttactctcaatgagtccaaccctaacacggtggaggtggccgtgagcacagaatccaaagcgaactctagaccccggcagctgtggaagaaatccgtggattccatacgccaggattcactatcccagaatccagtctcccagagggatgaggcaacagcagagaataggacccactccctaaagagccctaggtatcttccagaagagatggcccactctgacatttcagaaacgtcaaatcgggccacgtgccacagggaacctgacaacagtaagaaccacaaaaccaaggacaactttaaaaggtcagtggcctccaaataccccaaggactgtagtgaggtcgagcgcacctacctgaaaaccaaatcaagctcccctagagacaagatctacactatagatggtgagaaggagcctggtttccacttagatccaccccagtttgttgaaaatgtgaccctgcccgagaacgtggacttcccggacccctaccaggatcccagtgaaaacttccgcaagggggactccacgctgccaatgaaccggaaccccttgcataatgaagaggggctttccaacaacgaccagtataaactctactccaagcacttcaccttgaaagacaagggttccccgcacagtgagaccagcgagcgataccggcagaactccacgcactgcagaagctgcctttccaacatgcccacctattcaggccacttcaccatgaggtcccccttcaagtgcgatgcctgcctgcggatggggaacctctatgacatcgatgaagaccagatgcttcaggagacaggtaacccagccaccggggagcaggtctaccagcaggactgggcacagaacaatgcccttcaattacaaaagaacaagctaaggattagccgtcagcattcctacgataacattgtcgacaaacctagggagctagaccttagcaggccctcccggagcataagcctcaaggacagggaacggcttctggagggaaatttttacggcagcctgtttagtgtcccctcaagcaaactctcggggaaaaaaagctcccttttcccccaaggtctggaggacagcaagaggagcaagtctctcttgccagaccacacctccgataaccctttcctccactcccacagggatgaccaacgcttggttattgggagatgcccctcggacccttacaaacactcgttgccatcccaggcggtgaatgacagctatcttcggtcgtccttgaggtcaacggcatcgtactgttccagggacagtcggggccacaatgatgtgtatatttcggagcatgttatgccttatgctgcaaataagaataatatgtactctacccccagggttttaaattcctgcagcaatagacgcgtgtacaagaaaatgcctagtatcgaatctgatgtttaaaaatcttccattaatgttttatctatagggaaatacacgtaatggccaatgttctggagggtaaatgttggatgtccaatagtgccctgctaagaggaagaagatgtagggaggtattttgttgttgttgttgttggctcttttgcacacggcttcatgccataatcttccactcaaggaatcttgtgaggtgtgtgctgagcatggcagacaccagataggtgagtccttaaccaaaaataactaactacataagggcaagtctccgggacatgcctactgggtatgttggcaataatgatgcattggatgccaatggtgatgttatgatttcctatattccaaattccattaaggtcagcccaccatgtaattttctcatcagaaatgcctaatggtttctctaatacagaataagcaatatggtgtgcatgtaaacctgacacagacaaaataaaaacagttaagaatgcatctgcactgtagtcggatttgaacatgtgcaagagattaggaagtttggctcgtaacagtttcagctttcttgttatgccttccatcacagcccaggctcaccccaagaactccaggctcccctaaagaatagcaaatcagtgtgttcgtgatgactgtgctaccttcattatagttcatttccaagacacatctggagccaaaggcccgagggaccctcaggtggggagagctacaggaatctctttggatgttgatgtgtgtttctctctaccctcggcttcgatggtcttgttcagagctgcataaactaacacatttatgtctccgagatctaagtgtggatcttctgtctgtgacacagtggccattgtagtttatcccgaagacgcctatgtacgtaagtttgcatttcctcccttctggtgatgactcagggttgtatagtatctgttaccccttccctcccagagtaaccataactcgttccgtttccaaacagccatggtggtgtccaattagctgtgtatcgctcttcccagagttgttaatgtggtgacatgcaccaacagccgtatgtgtactgtgatctgtaagaagtacaatgccatctgtctgccgaaggctagcatggttttaggtttatcttccttcacatccagaaattctgttggacactcacttccaccccaaactcctcaaatcaaaagccttcaaaacacgaggcactcttggatctaccctgagtatcctccaaactgtggatacagtttagtgagacaagcaatttctcccttctgagttattctctctgttggtggcaaaccacttcatagcaccaacagagatgtaggaaaaattcctcaaagtatttgtcatttctgagtcgcctgcattatcccattcttattctcctcaaacctgtgcatatatgacatgaaatgatatccattttttttttaagttagaaacagagaggggaatacttatgcatggggagcctgttagcacagtgcctgccacaaaaacaagtgcccccgacaagatagttgctatgttatgacactttctcagatcaggattttctagtttaaaaattaaatatcataaaacg

SEQ ID NO: 340 - DNA, 1230 bp, Homo sapiens
catagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtgccccccacccgggtcccgggcccactggccccccgcagacgccgctacacactgactccagccaggctgcgctgggaccacctcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgttgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctgaaaaaaaaaaaaaa

SEQ ID NO: 341 - DNA, 1246 bp, Homo sapiens
ctgccccatgcagccctgagccccacagcaagtctgccatgggccgcggggcccgtgtcccctcggaggccccgggggcaggcgtcgagcgccgctggcttggagccgcgctggtcgccctgtgcctcctccccgcgctggtgctgctggcccggctgggggccccggcggtgccggcctggagcgcagcgcagggagacgtcgctgcgctgggcctctcggcggtcccccccacccgggtcccgggcccactggccccccgcagacgccgctacacgctgactccagccaggctgcgctgggaccacttcaacctcacctacaggatcctctccttcccgcggaacctgctgagcccgcgggagacgcggcgggccctagctgccgccttccgcatgtggagcgacgtgtcccccttcagcttccgcgaggtggcccccgagcagcccagcgacctccggataggcttctacccgatcaaccacacggactgcctggtctccgcgctgcaccactgcttcgacggccccacgggggagctggcccacgccttcttccccccgcacggcggcatccacttcgacgacagcgagtactgggtcctgggccccacgcgctacagctggaagaaaggcgtgtggctcacggacctggtgcacgtggcggcccacgagatcggccacgcgctgggcctgatgcactcacaacacggccgggcgctcatgcacctgaacgccacgctgcgcggctggaaggcgttgtcccaggacgagctgtgggggctgcaccggctctacggatgcctcgacaggctgttcgtgtgcgcgtcctgggcgcggaggggcttctgcgacgctcgccggcggctcatgaagaggctctgccccagcagctgcgacttctgctacgaattccccttccccacggtggccaccaccccaccgccccccaggaccaaaaccaggctggtgcccgagggcaggaacgtgaccttccgctgcggccagaagatcctccacaagaaagggaaagtgtactggtacaaggaccaggagcccctggagttctcctaccccggctacctggccctgggcgaggcgcacctgagcatcatcgccaacgccgtcaatgagggcacctacacctgcgtggtgcgccgccagcagcgcgtgctgaccacctactcctggcgagtccgtgtgcggggctgagcccggctgataaagcactttctctctgaaaaaaa

SEQ ID NO: 342 - DNA, 2690 bp, Homo sapiens
ataaaaacccagaaagccccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaataataataataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcattaaaaaaaaaaaaaa

SEQ ID NO: 343 - DNA, 2356 bp, Homo sapiens
ccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaaaaaaaaaaaaaaa

SEQ ID NO: 344 - DNA, 3469 bp, Homo sapiens
gcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctctaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgatattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacagaaacttcgtggcaaattgagatcaatgaggccaaaaggaaactgatggagaatattctgctctacaaagaggaaaaagtggacagcattgagctctttggcccctgatgaccggaacacagctgaggacccttgtcctcagttggaaagatgagcatcagatcaagaaaaaggtctgaggcagaatccaagatctgccaggaaacacacaacaaaacatctgctgtcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtc

SEQ ID NO: 345 - DNA, 1844 bp, Homo sapiens
tggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctstaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgaaattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacataa

SEQ ID NO: 346 - DNA, 5602 bp, Homo sapiens
atggagccctccagagcgcttctcggctgcctagcgagcgccgccgctgccgccccgccgggggaggatggagcaggggccggggccgaggaggaggaggaggaggaggaggaggcggcggcggcggtgggccccggggagctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagtatgtccttgttctttttggaaactctcggcaaagggcaaaccagcaagtattgagggtacccatctagctacttggggtcaggacctcgtcagaccaggttcggatacaatcatctgctcatcccaggaatagtttcttgggggactcactcactggtgccagttctaagtcagagacaaaattccactgtctgttccttttgctgtctgaactttatgtgttactcccttcctttggtcttcactctaatccctggagtttgtgggcttttggttatgtttggttagtagatatcaccgcaatgccctagaacagctatgaagcagaataccatatggccacctggacattgggacttgggaattcactctcaactgggccatccatgttgtgatgcccttgaagtaaaatggagccagcaggagtaccttctgtaaatgcatgtggcaaagtgctatttatagggtgcccagggagccgctgatgtacaataaccttgaggtcccccatactgaaaactgaccaaggcctgtgcacaggtagcccctcatgctgggctctggaccatgagctgagtaggaaggatagcagaggccaaccctgaccttcctggaagttgtttccttaacttgaatgttgagcttcctctaaagctttctcgtgtatgtcttctccatgccactactctgaggcctcctgtgttatgtgtgaacagttgtctttatgtgggaatgacgacttgattgggagtagagtctcaaggtcattcccctcttccctcaagactctctgaatgctgctccactgtcttttgtcttggaggtcactcagcaggttccttgcatttgctgcctggatgtgcagctggcaacagtgatgaattggtcactgctctttctctataactgggatagatgtcctgccttggggtcactaaaggggtgaccttgttccttgctttatgagcccattagcactttggttcaaggggcccaccaagtcttggacgggaaggcgctactggttttattgcccaaggttttgttattgcttctcttctgtgtccttctctttgttcagtgaagccaatatgtaagatactgtttttgtccccattcccctactcctgagctaggaggaaaaaatgtgaatcttaccagcagttccagccaaccaagtgattcttcttcattcttgatggggagaagtacatacaaagtttgttctgacagggcgcggtggctcacgcctgtaatcccagcgctttgggaggcagaggcaggtggatcacctgaggtcgggagttcgagaccagcctgaccaacatggagatatcctgtctctactaaaaatacaaaaaaattagccaggcatggtggcacgtgcctgtaatcccagctactcgcaaggctgaggcaggagaatcgcttgaacctgggaggcggaggttgcagtgagccaagattgcgccattgcactccagcctgggcaacaagagagaaactctgtctcaaaa

SEQ ID NO: 347 - DNA, 4350 bp, Homo sapiens
atggagggagctgcggcgggccagtgggcgggaagagtgggtcgacctgggtttgagaatgacagagcccgcaatgggggagggcacggtgcgacggcggcgcagggggcccgcgtcaggtggtcccggcgagctggcggtgcggggggcggggcacggcacggcgcggagaggagagcggcggccggctggcagcggcgggcaccggctgcgcgagcaggtaccggcggcagaggtgacgaggccgcccccgggggggcgagcgggcaggcggggactcggcccgctgcgcccctaggctgcgcgaagagctcgcgctcggcgctcttctcgtaccgcggtaacagcgccggcgagccggctctcccagccctgccagcccgggccctacctgcggccgccgtcctgggctgcgacgcgccgctgccctactggacggccgtgttcgagtacgaggcggcgggcgaggacgagctgaccctgcggctgggcgacgtggtggaggtgctgtccaaggactcgcaggtgtccggcgacgagggctggtggaccgggcagctgaaccagcgggtgggcatcttccccagcaactacgtgaccccgcgcagcgccttctccagccgctgccagcccggcggcgaggaccccagttgctacccgcccattcagttgttagaaattgattttgcggagctcaccttggaagagattattggcatcgggggctttgggaaggtctatcgtgctttctggataggggatgaggttgctgtgaaagcagctcgccacgaccctgatgaggacatcagccagaccatagagaatgttcgccaagaggccaagctcttcgccatgctgaagcaccccaacatcattgccctaagaggggtatgtctgaaggagcccaacctctgcttggtcatggagtttgctcgtggaggacctttgaatagagtgttatctgggaaaaggattcccccagacatcctggtgaattgggctgtgcagattgccagagggatgaactacttacatgatgaggcaattgttcccatcatccaccgcgaccttaagtccagcaacatattgatcctccagaaggtggagaatggagacctgagcaacaagattctgaagatcactgattttggcctggctcgggaatggcaccgaaccaccaagatgagtgcggcagggacgtatgcttggatggcacccgaagtcatccgggcctccatgttttccaaaggcagtgatgtgtggagctatggggtgctactttgggagttgctgactggtgaggtgccctttcgaggcattgatggcttagcagtcgcttatggagtggccatgaacaaactcgcccttcctattccttctacgtgcccagaaccttttgccaaactcatggaagactgctggaatcctgatccccactcacgaccatctttcacgaatatcctggaccagctaaccaccatagaggagtctggtttctttgaaatgcccaaggactccttccactgcctgcaggacaactggaaacacgagattcaggagatgtttgaccaactcagggccaaagaaaaggaacttcgcacctgggaggaggagctgacgcgggctgcactgcagcagaagaaccaggaggaactgctgcggcgtcgggagcaggagctggccgagcgggagattgacatcctggaacgggagctcaacatcatcatccaccagctgtgccaggagaagccccgggtgaagaaacgcaagggcaagttcaggaagagccggctgaagctcaaggatggcaaccgcatcagcctcccttctgatttccagcacaagttcacggtgcaggcctcccctaccatggataaaaggaagagtcttatcaacagccgctccagtcctcctgcaagccccaccatcattcctcgccttcgagccatccagttgacaccaggtgaaagcagcaaaacctggggcaggagctcagtcgtcccaaaggaggaaggggaggaggaggagaagagggccccaaagaagaagggacggacgtgggggccagggacgcttggtcagaaggagcttgcctcgggagatgaaggatcccctcagagacgtgagaaagctaatggtttaagtaccccatcagaatctccacatttccacttgggcctcaagtccctggtagatggatataagcagtggtcgtccagtgcccccaacctggtgaagggcccaaggagtagcccggccctgccagggttcaccagccttatggagatggccttgctggcagccagttgggtggtgcccatcgacattgaagaggatgaggacagtgaaggcccagggagtggagagagtcgcctacagcattcacccagccagtcctacctctgtatcccattccctcgtggagaggatggcgatggcccctccagtgatggaatccatgaggagcccaccccagtcaactcggccacgagtacccctcagctgacgccaaccaacagcctcaagcggggcggtgcccaccaccgccgctgcgaggtggctctgctcggctgtggggctgttctggcagccacaggcctagggtttgacttgctggaagctggcaagtgccagctgcttcccctggaggagcctgagccaccagcccgggaggagaagaaaagacgggagggtctttttcagaggtccagccgtcctcgtcggagcaccagccccccatcccgaaagcttttcaagaaggaggagcccatgctgttgctaggagacccctctgcctccctgacgctgctctccctctcctccatctccgagtgcaactccacacgctccctgctgcgctccgacagcgatgaaattgtcgtgtatgagatgccagtcagcccagtcgaggcccctcccctgagtccatgtacccacaaccccctggtcaatgtccgagtagagcgcttcaaacgagatcctaaccaatctctgactcccacccatgtcaccctcaccaccccctcgcagcccagcagtcaccggcggactccttctgatggggcccttaagccagagactctcctagccagcaggagcccctccagcaatgggttgagccccagtcctggagcaggaatgttgaaaacccccagtcccagccgagacccaggtgaattcccccgtctccctgaccccaatgtggtcttccccccaaccccaaggcgctggaacactcagcaggactctaccttggagagacccaagactctggagtttctgcctcggccgcgtccttctgccaaccggcaacggctggacccttggtggtttgtgtcccccagccatgcccgcagcacctccccagccaacagctccagcacagagacgcccagcaacctggactcctgctttgctagcagtagcagcactgtagaggagcggcctggacttccagccctgctcccgttccaggcagggccgctgcccccgactgagcggacgctcctggacctggatgcagaggggcagagtcaggacagcaccgtgccgctgtgcagagcggaactgaacacacacaggcctgccccttatgagatccagcaggagttctggtcttagcacgaaaaggattggggcgggcaagggggacagccagcggagatgaggggagctggcgggcacagccctttctcagggttggaccccctgagatccagccctacttcttgcactgataatgcactttgaagatggaagggatggaaacagggccacttcagagggtctcctgccctgcagggcctttctacccgtgtccactggaggggctgtggccatcagctctggctgtgtaggggaggaaggggtgcatgcatgtcccccaccctccacagtcttccttgcctttagagtgaccctgcagagtcactcagccaaatctgtctgctgctccctctcctcagccagttgggtgtgcgcagagctgtcatagggtccctttgtcagccccgagttcagcttcccaaacaccagtgttggatattctgtgattgattttggtcctcctccgctgtcccccaacacccaggaatgggaatctggcttggttcgagataggagcttttctgtgtcctaagccctttcatgctagcaggaagactgaaagcaaggtggcccagtgtggggtcatagggcttgatagacctggcactgcctatctgcacttccaggtgccccacctatttatctgagcccacaggtggaaaggggaactgcctcagtgagaacggggggacggggatgttaggaaaaatacagtaaagttgcaatgaagaggttcatgaagta

SEQ ID NO: 348 - DNA, 1548 bp, Homo sapiens
ctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggagttagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcaacacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaa

SEQ ID NO: 349 - DNA, 1767 bp, Homo sapiens
cagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaa

SEQ ID NO: 350 - DNA, 3795 bp, Homo sapiens
cagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaaa

SEQ ID NO: 351 - DNA, 4920 bp, Homo sapiens
gagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaagtacgtgcaggccagcgccccccgggccttccactccccattcctggggctctgggcccacccaacacaggcacccctatagaacagcagccctgctcacctggccaggaggcagtcctggaccaaagaatgcttggcgaggaggaggaagcagttggagagagaaggattctgggaaaggaaggggccactttggagcccaagcagcagaggattctgggggaagaatcaggagcccctagtcccagtccacaaaaacatgggagcctggttgatgaggaagtttggggtctgcctgaggagatagaggagcttagggtgccctcccttgtaccccaggagaggagcattgttggccaggaggaggctgggacatggagcttgtgggggaaggaggatgagagtcttctggatgaggagtttgagcttggctgggtccagggcccagcactgactcccgtccctgaggaggaggaagaagaggaagagggggctccgattgggacccctagggatcctggagatggttgtccttcccccgacatccctcctgaaccccctccaacacacctgaggccctgccctgccagccagctccctggactcctgtcccatggcctcctggccggcctctcctttgcagtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggcccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagcccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtccccttccccccaccaaaaaaagaaaaagacaaacacaaataaaatatctgagcggaactgtgaaaaaaaaaaa

SEQ ID NO: 352 - DNA, 4625 bp, Homo sapiens
gagaccgggacgagaccggggctgtggtgcggagagaggctgagacggagaagaggagaggcagagagggcgcggggaccgtcagcagcaccttagctacaatcgttcagctattctcggaagagagaagggagagggaggaggccggggcgggagtgggggctgtcaccctcggaccccggcgtgagaggggccgtgcggccggacgtcctcggggtgggcccccagtcggtggccgaagacctacagctcaggcccctgggtcccaaatttccaggctttgcccctcctcctttctcagatacccgggtaacagtcctcatagtccagatatccgggactcgggtcccaacctctctaaacctgggtctctgtttcatagaatttcaaatatcaggttcaggcccctgcgtgcaccagtatccggggttcattccccgggcgttcaaatatcggattcagtctccatcccgttcagatattcggggttcagaccccacaatcagaaatccggaattcggcagctgtcgccctcgacgagggggaggactggaccgcgaggtcagattaggttgtcaccccctcccctccaggggaggcttcccgggcccgcccctcaggaagggcgaaagccgaggaagaggtggcaaggggaaaggtctccttgcccctctccctgcttggcagagccgctggaggaccccaggcggaagcggaggcgctggggcaccatagtgacccctaccaggccaggccccactctcagggcccccaggggccaccatgccagctgggggccgggccgggagcctgaaggacccagatgtggctgagctcttcttcaaggatgacccagaaaagctcttctctgacctccgggaaattggccatggcagctttggagccgtatactttgcccgggatgtccggaatagtgaggtggtggccatcaagaagatgtcctacagtgggaagcagtccaatgagaaatggcaagacatcatcaaggaggtgcggttcttacagaagctccggcatcccaacaccattcagtaccggggctgttacctgagggagcacacggcttggctggtaatggagtattgcctgggctcagcttctgaccttctagaagtgcacaagaaaccccttcaggaggtagagatcgcagctgtgacccacggggcgcttcagggcctggcatatctgcactcccacaacatgatccatagggatgtgaaggctggaaacatcctgctgtcagagccagggttagtgaagctaggggactttggttctgcgtccatcatggcacctgccaactccttcgtgggcaccccatactggatggcacccgaggtgatcctggccatggatgaggggcagtacgatggcaaagtggacgtctggtccttggggataacctgcatcgagctggctgaacggaaaccaccgctctttaacatgaatgcgatgagtgccttataccacattgcacagaacgaatcccccgtgctccagtcaggacactggtctgagtacttccggaattttgtcgactcctgtcttcagaaaatccctcaagacagaccaacctcagaggttctcctgaagcaccgctttgtgctccgggagcggccacccacagtcatcatggacctgatccagaggaccaaggatgccgtgcgggagctggacaacctgcagtaccgcaagatgaagaagatcctgttccaagaggcacccaacggccctggtgccgaggccccagaggaggaagaggaggccgagccctacatgcaccgggccgggactctgaccagcctcgagagtagccactcagtgcccagcatgtccatcagcgcctccagccagagcagctccgtcaacagcctagcagatgcctcagacaacgaggaagaggaggaggaggaggaggaagaggaggaggaggaagaaggccctgaagcccgggagatggccatgatgcaggagggggagcacacagtcacctctcacagctccattatccaccggctgccgggctctgacaacctatatgatgacccctaccagccagagataacccccagccctctccagccgcctgcagccccagctcccacttccaccacctcttccgcccgccgccgggcctactgccgtaaccgagaccactttgccaccatccgaaccgcctccctggtcagccgtcagatccaggagcatgagcaggactctgcgctgcgggagcagctgagcggctataagcggatgcgacgacagcaccagaagcagctgctggccctggagtcacggctgaggggtgaacgggaggagcacagtgcacggctgcagcgggagcttgaggcgcagcgggctggctttggggcagaggcagaaaagctggcccggcggcaccaggccataggtgagaaggaggcacgagctgcccaggccgaggagcggaagttccagcagcacatccttgggcagcagaagaaggagctggctgccctgctggaggcacagaagcggacctacaaacttcgcaaggaacagctgaaggaggagctccaggagaaccccagcactcccaagcgggagaaggccgagtggctgctgcggcagaaggagcagctccagcagtgccaggcggaggaggaagcagggctgctgcggcggcagcgccagtactttgagctgcagtgtcgccagtacaagcgcaagatgttgctggctcggcacagcctggaccaggacctgctgcgggaggacctgaacaagaagcagacccagaaggacttggagtgtgcactgctgcttcggcagcacgaggccacgcgggagctggagctgcggcagctccaggccgtgcagcgcacgcgggctgagctcacccgcctgcagcaccagacggagctgggcaaccagctggagtacaacaagcggcgtgagcaagagttgcggcagaagcatgcggcccaggttcgccagcagcccaagagcctcaaatctaaggagctgcagatcaagaagcagttccaggagacgtgtaagatccagactcggcagtacaaggctctgcgagcacacttgctggagaccacgcccaaagctcagcacaagagcctccttaagcggctcaaggaagagcagacccgcaagctggcgatcttggcggagcagtatgaccagtccatctcagagatgctcagctcacaggcgctgcggcttgatgagacccaggaggcagagttccaggcccttcggcagcagcttcaacaggagctggagctgctcaacgcttaccagagcaagatcaagatccgcacagagagccagcacgagagggagctgcgggagctggagcagagggtcgcgctgcggcgggcactgctggagcagcgggtggaagaggagctgctggccctgcagacaggacgctccgagcgaatccgcagtctgcttgagcggcaggcccgtgagatcgaggccttcgatgcggaaagcatgaggctgggcttctccagcatggctctggggggcatcccggctgaagctgctgcccagggctatcctgctccaccccctgccccagcctggccctcccgtcccgttccccgttctggggcacactggagccatggccctcctccaccaggcatgccccctccagcctggcgtcagccgtctctgctggctcccccaggccccccaaactggctggggccccccacacaaagtgggacaccccgtggcggagccctgctgctgctaagaaacagcccccagcccctgcggcgggcagcctcggggggcagtggcagtgagaatgtgggcccccctgctgccgcggtgcccgggcccctgagccgcagcaccagtgtcgcttcccacatcctcaatggttcttcccacttctattcctgaggtgcagcggggaggagcagatgagctgggcagggcaggggtgggtggagcctgaccctggagggcactgagctggaggcccctgcaagggtaggggacaagatgtaggctccagctcccctcagacctcctcatctcatgagcttcttggggctggccagtggcccagggccagcttggcgataggtgcctcaaggctgcctgggagccccgcctccctaccatggtgccaggggtctccctccgccacctaggaaaggagggagatgtgcgtgtcaaatattcatctagtcccctgggggaggggaagggtgggtctagacatactatattcagagaactatactaccctcacagtgaggccctcagacctgccacagggcagagcaggtctggggcctgaggcagggagaatgagaggccaccttactggcaggaaggatcaggatggggtcttggggtcaggatgcctgggtctcttcccgtaactgtctgacgtcctgtgccgtcttgtcctttatctttttttttttttttttaattgggatcagggctggggcggggaaacaagggaaggaccttggaaggggctgctcccaggcctggggggcagtcgtgggagcccctctcagctgtggggctggcacagagccccaggcaagcttttaataaactgttggttattctaacag

SEQ ID NO: 353 - DNA, 5316 bp, Homo sapiens
gggagcggagacggagaacaggttatgtgggagccggcgggggcatttgccggcgacacccgagcgggggccggaagtggggccacagctcgcagcaggagctccgggctagaccgtggcgccggcagcggcccctgggctggaggaggatgatgaggagcgacggaagcgacgcgggggtacgctgctgcgcggcgcccggtttcgtgcccgcggccgactgcgcagcctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggcattatcttacttttgttaatattcatatcaatagcaggtattctgtataaattccaggatgtattgctttattttccagaacagccatcctcttcacgtctttatgttcccatgcccactggcattccacatgaaaacattttcatcagaaccaaagatggaatacgtctgaatcttattttgatacgatacactggagacaattcaccctattccccaactataatttattttcatgggaatgcaggcaacataggtcacaggttgccaaatgcattacttatgttggttaacctcaaagttaaccttttgctggttgattatcgaggatatggaaaaagtgaaggagaagcaagtgaagaaggactctacttagattctgaagctgtgttagactacgtgatgactagacctgaccttgataaaacaaaaatttttctttttggccgttccttgggtggagcagtggctattcatttggcttctgaaaattcacataggatttcagccattatggtggagaacacatttttaagcataccacatatggccagcactttattttcattctttccgatgcgttaccttcctttatggtgctacaaaaataaatttttgtcctacagaaaaatctctcagtgtagaatgccttcacttttcatctctggactctcagatcaattaattccaccagtaatgatgaaacaactttatgaactctccccatctcggactaagagattagccatttttccagatgggactcacaatgacacatggcagtgccaaggctatttcactgcacttgaacagttcatcaaagaagtcgtaaagagccattctcctgaagaaatggcaaaaacttcatctaatgtaacaattatataatgtttccctttttgattattgcattgtattttaatttgtgcagaatgataaagaatgttccttttagaagtgtgttatgtctgtacctgtctgaagagtgacattaaactttgaaaggacttcactgctcctttacgatattccaaatagttttttacattggaaaaactaattcttgggattctttcatacattttcatcaaaactttcagtgtgattatgtattcatatcttcagtttaatatgtcagtataatagatattgttcaaaagtttcttgttgctaaagtggtgtaatctgttacacagatgaatagctagatgtggaaagagatatgtaaacaagaaacctttgggtattgtttcttaagtaaatattgggacaatcatggtaagcaaacttagttctgtaactgcatttttcaccttaaaagttaaatgaaatgcatgatggtattttattccttgaattatgcaatgcaacattttacatgtaaatagcactggtcatatactgatgtatatggttatctgggttatatctatttttatgtaaactctattttgtttttggcaagaagtgaaattgagacttatgtgcaggttgccattgaattttgctctggtgaatgctgagatccagctttttcttacaaataaatgggaccctgttttccaatacaaatgtaccgtgtttttgttaggtacagtctggatcatggcatgtagaaatagaaatttagaattttactgcagctttgatgtgcatatttgaactttttaacatttgtaactttggtggcaaagagaattttagcttctatcgattttgtaagtcttcagctgaaccactaatagcagtcatagtgaagattagcactacttagaattaaattaggaagtcttttatcattgcaggattgtacatactactttataaaaattctcacctttgattttaaatcccagtacctagttatatctaacctatcaaaggcaagatatcatttattggacttcttgaaaataaaagttacaaaatccaacaacaacaacaacaaaacaatgttcttggttttaatgttccagttgctgtgaaatagaactcctacaatcaaaagacagttttaggaagtcttatttattgattttaaaagttttacatgtaggagtgtgggaatgaaggaattctggagctttttgacacaaaacctattaccacatttagcagttaaatggctataggtgggaagtaggatttagatgtatagaaaagtaagaaaatcttacttagaaaaaagccccttgaaacttgcaggatttacttaataaaaatacacgctatgagtcataattgtgccaagttgtttcatgcagtcctcaaaaattagatgtaattgagctttgtgtaatattatgtcagctttaacatataatattttgaatattttagctatatttagtggctttctgcaagcaactagaacagagaagtaatgggtcaataatcttgaccttaatttaaaactttcaatggagatagggctagaaatacttttgccaaatagcattcttattcactttatgccggtatttagaaaaaataaattatagcaagtatgatttctaagaatgtttttctataaattactaattgtaaaaagtcttgctttttaaaacaagttggtaatgcatatcatggaaggcatattttgtatgtataaattcaccacaattaaagattattcttgtcagtccttgctatgtagaatgactattctaaatattaatgtattaaaaagaaaatacaacaaaatgtatatttagacacgagcttacatggcataccttatatttgtatcattctttaaagtttacaaaaaaaaaccttatgtttttatgtaatcagtcattacactagggagaaatttatcagctttagttctaaatatgctcatgaggtataaaagctatttcttcatcagtattttgcttttatgctgctttttctttttgatactccaggtttataaactatcttttaaaattttaagccaggacttcaaaaattgtagagtacttgtttggcgttccctaccttcattctcttagggttaaggagcctttctttctgcagctaagggcagaggctgtgcctagggctataccaccactagcatctgtatttgagactgtttccttagatgggtaagaggtggaaaacaaacttagtatcaggggtccatgaagcccatggcatcatttttgaaaatatttctagttttgtagccaaagcaattggttttagtaaaatgagacttcttcaggagtcactcctttactgtggacccattgcttagtgggaatggaagtatatgtatctatcttgtgtattaacttctgacttatttatacaagagcagctataggagtttacaaaagaactttaagttattaagttactataaatttggggatcctagagtgatcttaaatatggcaagatacagctcatttagaataaaatctcacatccattattttaaagggaatgattggggggaaaaactggtgaaaaagaaatataaaaaggaccctaaaaagaattctgcaaaataagagaagaaataatttgtgacaggtaatagaatactagtaggatagaaacaactagaaaggaaagtgtgacacagtttttaaatttagatgtagaaaataatgaattaatgagattggtgaaaggaaatcatgcaaaacatttgaatgcaaagcatttctaacaaaaagtgactggagcacttgccattgcaacaaccctgtttttgcaattaggtttttgactgttaaaatggatattttcataaaaatggtgttctgaattttgctacagggctgcttaaatttatgattacctgtagacacttgatatttacatagattacagctttggtaatatgtcactggagtaattacgctgtaatacctgttgagaattcataccatctgatgcttatatattaatttcttatgtttgtaagtttggctttgtgggaataggtgtggagaaattaaagagtgaaggccatatttcattttttataaattatctttcaagctcagatagcttaagagcagtttatattaaggagacccttttctccttgaggatagggataggtaaggtaaacttgtaaaaaggatgtcacagaagtcactttttaattaagtcatgattgagatactgaactcttccactcattcttctttcccattttcctattatgtttgataattatatgtatttttaaaaactgtgagaggaaaaattagtcataacccttttgggttatccacttaaatttaggtattttcatattactcaggtaaagatggaaatgacagagcacagacatttattttttaaattgatagggtagaaaatgaaatgtacttctgtttattcttaatactatatatatatatacacacatagttttagcaaattggaaataatatattcatttgtatggcaagataaatgcagtcatcttaatactagtctatacatttttgccaaatggcgcaaatatacctccatttatattttgtatcttaaaatgtagtttaaaaataggaccatgtatgagacacttttttacaaaaagtgccgtatatacatatgtaacaggtgagtgtgtgtttaacataatttataattatttctgtcagtacagcgtatatggaaaattcaagttgtttttaacatattcaagtatgttcagtataaaataagttaatcccatttcataatgtaaatcatatttttgttatttgccatattttatttgaagtgataaaattttataactcaaatttgaatgtcatagtacattgtgtgctaaccatggcaagcaaacatttacatttgttttttacaataaatttcttttaaaatatactttctatttttctgtactgacatatgcaataaattggtacattaaaaatttgattaatgtcttcaaaaaaaaaaaaaaa

SEQ ID NO: 354 - DNA, 1866 bp, Homo sapiens
agcccctaaagcagcactaattgcaaggatttctcaggtgactggttagtatgtggtgtcaatcatgaaaaagaagaactgcacgaaagtatctttctgaaaacttgcaaaactgagaagctagtctgtttaaaacaggaagttatatacttacattgtttactactttactaatgtctgtgatctgatggtatctctgtttcaggagtggtgacgcctaagctatcactggacatatcaaggacttcactaaattagcaggtaccactggtcttcttgtgcttatccgggcaagaacttatcgaaatacaatagaagtttttacttagaagagattttcagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaactattttattttctaatgtgcctagttctttccctgcttaatgaaaagctt

SEQ ID NO: 355 - DNA, 1945 bp, Homo sapiens
agcccctaaagcagcactaattgcaaggatttctcaggtgactggttagtatgtggtgtcaatcatgaaaaagaagaactgcacgaaagtatctttctgaaaacttgcaaaactgagaagctagtctgtttaaaacaggaagttatatacttacattgtttactactttactaatgtctgtgatctgatggtatctctgtttcaggagtggtgacgcctaagctatcactggacatatcaaggacttcactaaattagcaggtaccactggtcttcttgtgcttatccgggcaagaacttatcgaaatacaatagaagtttttacttagaagagattttcagcagatgagaagctggtaacagagaccaaaatagtttggagactaaagaatcattgcacatttcactgctgagttgtattggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtgcaacactgaagctcttgaagacactgaaatatacacacagcagtagcagtagatgcatgtaccctaaggtcattaccacaggccaggggctgggcagcgtactcatcatcaaccctaaaaagcagagctttgcttctctctctaaaatgagttacctacattttaatgcacctgaatgttagatagttactatatgccgctacaaaaaggtaaaactttttatattttatacattaacttcagccagctattgatataaataaaacattttcacacaatacaataagttaactattttattttctaatgtgcctagttctttccctgcttaatgaaaagctt

SEQ ID NO: 356 - DNA, 8089 bp, Homo sapiens
tggttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctg

SEQ ID NO: 357 - DNA, 8060 bp, Homo sapiens
aatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagagccttaggactgttacagctgagcattatgatgttaacaactcagccatctggcacaggggaagaggcacctaaacagattcttctggacaaaagtcacatatgagcaagatcagaatagtagcagatgtaaaaagcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctg

SEQ ID NO: 358 - DNA, 2545 bp, Homo sapiens
actcattcacataaaacgctgcgcggccggcggaatccccggcttctagggcggcgagcggccgggctggctatcgagcgagcggggcgggaacgcggagttgcgccgccgctcgggcgccgggctccgtcgcggccgcagccccgcgggtcgccctcccgtgcctcgcccgcggacaccctggccgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggccttcgctgcctcgaacgtgcgcggctcgctcaacgtcaacctcaactcggtggtgctgcggcgggcccggggcggcgcggtgtcggcgcgctacgtgctgcccgacgaggcggcgcgcgcgcggctcctgcaggagggcggcggcggcgtcgcggccgtggtggtgctggaccagggcagccgccactggcagaagctgcgagaggagagcgccgcgcgtgtcgtcctcacctcgctactcgcttgcctacccgccggcccgcgggtctacttcctcaaagggggatatgagactttctactcggaatatcctgagtgttgcgtggatgtaaaacccatttcacaagagaagattgagagtgagagagccctcatcagccagtgtggaaaaccagtggtaaatgtcagctacaggccagcttatgaccagggtggcccagttgaaatccttcccttcctctaccttggaagtgcctaccatgcatccaagtgcgagttcctcgccaacctgcacatcacagccctgctgaatgtctcccgacggacctccgaggcctgcgcgacccacctacactacaaatggatccctgtggaagacagccacacggctgacattagctcccactttcaagaagcaatagacttcattgactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtaaccctacagggtttgtagggacatgatcagcatcctgatttgaaccctgaaatgttgtgtagacaccctcttgggtccaatgaggtagttggttgaagtagcaagatgttggcttttctggattttttttgccatgggttcttcactgaccttggactttggcatgattcttagtcatacttgaacttgtctcattccacctcttctcagagcaactcttcctttgggaaaagagttcttcagatcatagaccaaaaaagtcataccttcgaggtggtagcagtagattccaggaggagaagggtacttgctaggtatcctgggtcagtggcggtgcaaactggtttcctcagctgcctgtccttctgtgtgcttatgtctcttgtgacaattgttttcctccctgcccctggaggttgtcttcaagctgtggacttctgggatttgcagattttgcaacgtggtactactttttttttctttttgtctgttagttatttctccaggggaaaaggcaataattttctaagacccgtgtgaatgtgaagaaaagcagtatgttactggttgttgttgttgttcttgttttttatagtgtaaaataaaaatagtaaaaggagaaaagcaaaaaaaaaaaaaaaaaa

SEQ ID NO: 359 - DNA, 2070 bp, Homo sapiens
gttcgatgctggtttagggtttcaggcgtggaggttccaaaatccgaggtttgatttcagcctgcccttgccagtgcctgggccgctgggagccgttattggctgccgttaaggaccgttacgtttcccgggtccttctggcactcctctggtggaccgcccccatcggccacacttgccctgctctccagtgattctgtagctcctggctccgtagtctcgcggacagctctctttcctggaagatgtttctggtgggcctgacagggggcattgcctcaggcaagagctcagtgatccaggtgttccagcagctgggctgtgcggtgattgacgtggacgtgatggcccggcacgtcgtgcagccaggataccctgcccaccggcgcatcgtagaggtcttcggcactgaggtcttgctggagaatggcgacataaatcgcaaggtcctgggggacctgatctttaaccagcctgaccggcggcagctgctcatcgccatcacccaccccgagattcgcaaggagatgatgaaggagacgttcaagtacttcctccggggataccgctacgtgattctggatatccccctgctgtttgagaccaagaagttgctcaagtacatgaagcacaccgtggtagtatactgcgaccgggacacacagctggcacggctgatgcggcggaacagcctgaaccgcaaggacgcagaggcccgcatcaatgcccagctgcccctgacagacaaggcccgcatggcccgccatgtcctagacaactcgggcgagtggagtgtcaccaaacgccaggtcatcctcttgcacactgagctggagcgctccctggagtacctgccgctgaggtttggggtcctcacagggctcgctgccattgccagcctcctctacctgctcacccactaccttctgccttacgcctagtggggcactcaaggcagggagccccaggcctccatctatctccttggaggctgaagccaggtaacacatcctgtttcctctcagccccctccacacacacacacacacacacacacacacacacacacacacacacggactctccgaatcagggctgggcctctgtgccaggccatcccgtctttggagtgtatcctatttgaggtcaagaaatagcctgctgtccttcccaccttccctgagcagcacctacagaacagcaaccgtgatggtgtgtgaaagcaacagtcagagactgctatacatttctgtgggtgggggtagggaatactggctctgtggccctcctcagagctgggaggccaagggttcactgggcttgaatcctctctaagcacctaccccattatggcctaaacctcctcagtggaccacgggaaatcatgttggaccaagggtttccatgttcaaacagtcaacaaggccctcccctaggttgagatatttttgatactgaaggcccaggccccccagtatggcttgctgccagcaagcagcaaggattctctcgtgggtaacgctgtagccaggcaggaccagcctcttctgggagacccctctccccacgtagggtttgtgtagtgctcccacatcctgcttattgcctgccacccctgcttctcgcctggacctcttggtattccgtgtacaccatccttgctgtttcttgcctctgtgccttcaacctgctgctcctggcctgggataccttttattttcttttatttcttcttccttttttttttttttttttttttttaacctacaactagctctcagttcaggcactgtctaaagccccaggctgggttaggtggtctaggataccaactccccctcaacattttaccttaatccaacagtacagtaattagccgaaacttgcctggtttttcctactagactgtaagccctctagggacagggacagtgtcttattcatctctgtgttcttagtgcagagcctggcccgctgttggtgtttaataaagtgtgttgatctgaaatgccccagaccaaaaaaaaaaaaaaaaaaaaaaaaaaaaaaaaaaaaaaaaaaaaaaaaaaa

SEQ ID NO: 360 - DNA, 918 bp, Homo sapiens
atggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttctag

SEQ ID NO: 361 - DNA, 1305 bp, Homo sapiens
atggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccgcgccccagacccctgccttgctcctgcgaaagtgccttctag

SEQ ID NO: 362 - DNA, 1074 bp, Homo sapiens
gatcaacacatttcatctgggcttcttaaatctaaatctttaaaatgactaagttttcttccttttctctgtttttcctaatagttggggcttatatgactcatgtgtgtttcaatatggaaattattggagggaaagaagtgtcacctcattccaggccatttatggcctccatccagtatggcggacatcacgtttgtggaggtgttctgattgatccacagtgggtgctgacagcagcccactgccaatatcggtttaccaaaggccagtctcccactgtggttttaggcgcacactctctctcaaagaatgaggcctccaaacaaacactggagatcaaaaaatttataccattctcaagagttacatcagatcctcaatcaaatgatatcatgctggttaagcttcaaacagccgcaaaactcaataaacatgtcaagatgctccacataagatccaaaacctctcttagatctggaaccaaatgcaaggttactggctggggagccaccgatccagattcattaagaccttctgacaccctgcgagaagtcactgttactgtcctaagtcgaaaactttgcaacagccaaagttactacaacggcgacccttttatcaccaaagacatggtctgtgcaggagatgccaaaggccagaaggattcctgtaagggtgactcagggggccccttgatctgtaaaggtgtcttccacgctatagtctctggaggtcatgaatgtggtgttgccacaaagcctggaatctacaccctgttaaccaagaaataccagacttggatcaaaagcaaccttgtcccgcctcatacaaattaagttacaaataattttattggatgcacttgcttcttttttcctaatatgctcgcaggttagagttgggtgtaagtaaagcagagcacatatggggtccatttttgcacttgtaagtcattttattaaggaatcaagttctttttcacttgtatcactgatgtatttctaccatgctggttttattctaaataaaatttagaagactcaaaaaaaaaaaaaaaaaaaaaaaaaaaaa

SEQ ID NO: 363 - DNA, 930 bp, Homo sapiens
atgagggaaaataaccagtcctctacactggaattcatcctcctgggagttactggtcagcaggaacaggaagatttcttctacatcctcttcctgttcatttaccccatcacattgattggaaacctgctcattgtcctagccatttgctctgatgttcgccttcacaaccccatgtattttctccttgccaacctctccttggttgacatcttcttctcatcggtaaccatccctaagatgctggccaaccatctcttgggcagcaaatccatctcttttgggggatgcctaacgcagatgtatttcatgatagccttgggtaacacagacagctatattttggctgcaatggcatatgatcgagctgtggccatcagccacccacttcactacacaacaattatgagtccacggtcttgtatctggcttattgctgggtcttgggtgattggaaatgccaatgccctcccccacactctgctcacagctagtctgtccttctgtggcaaccaggaagtggccaacttctactgtgacattacccccttgctgaagttatcctgttctgacatccactttcatgtgaagatgatgtacctaggggttggcattttctctgtgccattactatgcatcattgtctcctatattcgagtcttctccacagtcttccaggttccttccaccaagggcgtgctcaaggccttctccacctgtggttcccacctcacggttgtctctttgtattatggtacagtcatgggcacgtatttccgccctttgaccaattatagcctaaaagacgcagtgatcactgtaatgtacacggcagtgaccccaatgttaaatcctttcatctacagtctgagaaatcgggacatgaaggctgccctgcggaaactcttcaacaagagaatctcctcgtaa

SEQ ID NO: 364 - DNA, 930 bp, Homo sapiens
atgaagaaagaaaatcaatcctttaacctggattttattctcctgggagttactagtcagcaagaacagaataatgtcttctttgtgatttttttgtgcatttaccccatcacactgactggaaatctgctcatcatcttggccatctgtgctgacattcgccttcacaaccccatgtattttctccttgccaacctctccttggttgacatcatcttctcatccgtaaccatccctaaggtgctggccaaccatctcttgggcagcaagttcatctcctttgggggatgcctaatgcagatgtatttcatgatagccttggccaaggcagacagctataccttggctgcaatggcatacgatcgagctgtggccatcagctgcccacttcattacacaacaattatgagtccacggtcttgtatcctgcttattgctgggtcttgggtgattggaaacaccagtgctctcccccacactctgctcacagctagtttgtccttctgtggcaaccaggaagtagccaatttctactgtgacattatgcctttgctgaagttgtcctgttctgacgtccactttaatgtgaagatgatgtacctaggggtcggcgttttctctttgccattactatgcatcattgtctcctatgttcaggtcttttccacagtcttccaagttccatctaccaagagtctattcaaagccttctgcacctgtggctcccacctcacagttgtttttttatattatggtacaacgatgggcatgtatttccgccctctgaccagttacagccccaaagatgcagtgataactgtgatgtatgtggcagtgaccccagcattaaatcctttcatctatagtctgagaaattgggatatgaaggcagccctacagaaactcttcagcaagagaatctcctcatag

SEQ ID NO: 365 - DNA, 1758 bp, Homo sapiens
agcaagcggcctgtgcccagatcctgggagaaccccagccgagcccagcctagcccgagcccagcccgagcggagccggagccccaagcccgagccgcgcccagcccgagcagagccctccagccgctcaccccgcgtgccaccccagcgaccctcagccgctctctgcccttctctcggccccgcgcccgccctcgcggcccctctgcccaatgaaactggccgcgatgatcaagaagatgtgcccgagcgactcggagctgagtatcccggccaagaactgctatcgcatggtcatcctcggctcgtccaaggtgggcaagacggccatcgtgtcgcgcttcctcaccggccgcttcgaggacgcctacacgcctaccatcgaggacttccaccgcaagttctactccatccgcggcgaggtctaccagctcgacatcctcgacacgtccggcaaccacccgttccccgccatgcggcgcctctccatcctcacaggagacgttttcatcctggtgttcagtctggacaaccgcgactccttcgaggaggtgcagcggctcaggcagcagatcctcgacaccaagtcttgcctcaagaacaaaaccaaggagaacgtggacgtgcccctggtcatctgcggcaacaagggtgaccgcgacttctaccgcgaggtggaccagcgcgagatcgagcagctggtgggcgacgacccccagcgctgcgcctacttcgagatctcggccaagaagaacagcagcctggaccagatgttccgcgcgctcttcgccatggccaagctgcccagcgagatgagcccagacctgcaccgcaaggtctcggtgcagtactgcgacgtgctgcacaagaaggcgctgcggaacaagaagctgctgcgggccggcagcggcggcggcggcggcgacccgggcgacgcctttggcatcgtggcacccttcgcgcgccggcccagcgtacacagcgacctcatgtacatccgcgagaaggccagcgccggcagccaggccaaggacaaggagcgctgcgtcatcagctaggagccccgccgcgctggcgacacaacctaaggaggacctttttgttaagtcaaatccaacggcccggtgcgccccaggccgggagcgcgcgcggactggcgtctcccctcccggcgatccgcccccagcactggggaggcgccactgaaccgagaagggacggtcatctgctccggaaggaaagagaacgggccaagactgggactattccccacccccggtcccccattgaggcccgccacccccataactttgggagcgagggcccagccgagggtggatttatcttctcaaagacctaagagtgagcgcggggtgggggagggatgtgaagttatccagcctctgctaggcttcaagaaaccgtcatgcccgcttgagggtcaggacccacggggcattatcttgtctgtgattccgggttgctgtgacagccggtagagcctctgccctcccgaaactaagcgggggggcgtgggtcaaatcatagccaagtgacttgtttacatgtgagtgaaactgcacaaaggaacacaaaacaaaacttgcactttaacggtagttccggtgtcaacatggacacgaacaaaaccttacccaggtgtttatactgtgtgtgtgtgaggtctttaaagttattgctttatttggttttttaatatacaataaaataatttaaaatggaaaaaaaaaaaaaaaa

SEQ ID NO: 366 - DNA, 1982 bp, Homo sapiens
ggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttctcgtgccgaattcaaaaagctt

SEQ ID NO: 367 - DNA, 2273 bp, Homo sapiens
ctccagccgctgctcaccaggcagagcgagcgggcttggctggggcttcctgccctgagcgcgacaccgactgctccggaccgcgcctccaagcaggctgaagggcttccgctcttggcttccagaaaagtttggagaaagagaatttgaggcggattggagggtggtagcccctccccagccttctttctctcccagaagcctcactctgcacagcgtcccccattcttcccgtcctgattccccatcttcctgacccctccttctccctctcctgggtcgatcccagtcacattttctccttccgaatctcatcctccctcctcctctctatcccagtcctctgaacgatttccgcctatttggaagccttctccctgtcattctcaacgcttctcctttctctccacctcccctgccactccattttatccatcaaacctctccacttggatccacaccctcccttcatccttccctcccagcaaaccttgctcatggattctgggcctctgtgggatgccaaccccacccctcggggcaccctctctgcccccaatgccacaacaccctggctgggccgggatgaggagctggccaaggtggagatcggagtcctggccactgtcctggtgctggcgaccgggggcaacctggctgtgctgctgaccctgggccagctgggccgcaagcgctcccgcatgcacctgttcgtgctgcacttagccctgacagacctggccgtggcgctcttccaggtgctgccacagctgctgtgggacatcacctaccgcttccagggccccgacctcctgtgcagggccgtcaagtacctgcaggtgctcagcatgtttgcctccacctacatgctgctggccatgacgctggaccgctacctggctgtctgtcaccccctgcgcagcctccagcagccaggccagtccacctacctgctcatcgctgctccctggctgctggccgccatcttcagcctccctcaagtcttcattttttccctgcgggaggtgatccagggctcaggggtgctggactgctgggcagacttcggcttcccttgggggccacgggcctacctcacctggaccaccctggctatcttcgttctgccggtgaccatgctcacggcctgctacagcctcatctgccatgagatctgtaaaaacctaaaagtcaagacacaggcctggcgggtgggaggagggggctggaggacttgggacaggccctcaccttccaccttagctgccaccactcgggggctgccatctcgggtcagcagcatcaacaccatctcacgggccaagatccgaacagtgaagatgacctttgtcatcgtgctggcctacatcgcttgctgggctcccttcttcagtgtccagatgtggtccgtgtgggacaagaatgcccctgatgaagattccaccaatgtggctttcaccatctctatgcttttgggcaacctcaacagctgctgcaacccctggatctacatgggcttcaacagccacctgttaccgcggcccctgcgtcaccttgcctgctgtgggggtccccagcccaggatgcgccggcggctctccgacggcagcctctcgagccgccacaccacgctgctgacccgctccagctgcccggccaccctcagcctcagcctcagcctaaccctcagtgggaggcccaggcctgaagagtcaccaagggacttggagctggcagatggggaaggcaccgctgagaccatcatcttttaggaaagactcgctggggtctggtactgcccccaggactagtggaggttctctgcccacctcaggcactggaaatgagagctgggagggtaagggttggagttagaggaggccctgtctgaagcagagccaaaaggccagaatgggtcccctaccctggtgtcacagctgcccctagtgtgagggctgcctcataagctcccaatctcagacactggcagtcagggagaatcaaactgcctgtctccctggtcctgccatattcatagggtgtccatgcacacatggtgtcccagatctaggcaggcctaggatggtgctgtctaggggtccacgggtggcaggaattcagaggctggccttgtgccctggctacctgtctccattctaacctgactggcacatctcagcctaaccaggagaggggagaagtgaaaaaccgtgaggaggactctatttggatcctggatttgttgttgttgttgttgttgttgttagagagaa

SEQ ID NO: 368 - DNA, 3001 bp, Homo sapiens
ggagtctgtcagctacggaggacaatgaccttgcagacaccaccgcctgagtgagaaccaggggtctgtgcctctcctcattccccgctcttgcccttgtcaagcctgcaccagcatgtcaggaacctccaaggagagtctggggcatggggggctgccagggttgggcaagacctgcttaacaaccatggacacaaagctgaacatgctgaacgagaaggtggaccagctcctgcacttccaagaagatgtcacagagaagttgcagagcatgtgccgagacatgggccacctggagcggggcctgcacaggctggaggcctcccgggcaccgggcccgggcggggctgatggggttccccacattgacacccaggctgggtggcccgaggtcctggagctggtgagggccatgcagcaggatgcggcccagcacggtgccaggctggaggccctcttcaggatggtggctgcggtggacagggccatcgctttggtgggggccacgttccagaaatcaaaggtggcggatttcctcatgcaggggcgtgtgccctggaggagaggcagcccaggtgacagccctgaggagtgggtaaaagaggaggaggtctgtttcatgcctccagttcccccagctccgggggcagcaggacagagcctgcagaaggataagggggagctgtctgccgagcaggggatctgggccacattgatgacgctggtgatcatggtgacagcggcaaataaagagcgagtggaagaagagggaggaaaaccaaagcatgtgctgagcaccagtggggtgcagtctgatgccagggagcctggggaagagagccagaaggcggacgtgctggaggggacagcggagaggctgccccccatcagagcgtcagggctgggagctgaccccgcccaggcagtggtctcaccgggccagggagatggtgttcctggcccagcccaggcattccctggccacctgcccctgcccacaaaggtggaagccaaggctcctgagacacccagcgagaacctcaggactggcctggaattggctccagcacccggcagggtcaatgtggtctccccgagcctggaggttgcaccaggtgcaggacaaggagcatcgtccagcaggcctgaccctgagcccttagaggaaggcacgaggctgactccagggcctggccctcagtgcccagggcctccagggctgccagcccaggccagggcaacccacagtggtggagaaacacctccaagggcagccctgctgaagggcgctgtggccccgggcttctctcggagggacctggtgtttcctagcatcttctgcgcctgcctagggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggctttttggtattattgattccacttattttgtaaaaatggttatggctgctgccttccttgtggatgaaaagtggctgtaaagaagcttcctaagaacgttt

SEQ ID NO: 369 - DNA, 2760 bp, Homo sapiens
aggagtctgtcagctacggaggacaatgaccttgcagacaccaccgcctgagtgagaaccaggggtctgtgcctctcctcattccccgctcttgcccttgtcaagcctgcaccagcatgtcaggaacctccaaggagagtctggggcatggggggctgccagggttgggcaagacctgcttaacaaccatggacacaaagctgaacatgctgaacgagaaggtggaccagctcctgcacttccaagaagatgtcacagagaagttgcagagcatgtgccgagacatgggccacctggagcggggcctgcacaggctggaggcctcccgggcaccgggcccgggcggggctgatggggttccccacattgacacccaggctgggtggcccgaggtcctggagctggtgagggccatgcagcaggatgcggcccagcacggtgccaggctggaggccctcttcaggatggtggctgcggtggacagggccatcgctttggtgggggccacgttccagaaatcaaaggtggcggatttcctcatgcaggggcgtgtgccctggaggagaggcagcccaggtgacagccctgaggagaataaagagcgagtggaagaagagggaggaaaaccaaagcatgtgctgagcaccagtgggttgcagtctgatgccagggagcctggggaagagagccagaaggcggacgtgctggaaaggacagcggagaggctgccccccatcagagcgtcagggctgggagctgaccccgcccaggcagtggtctcaccgggccagggagatggtgttcctggcccagcccaggcattccctggccacctgcccctgcccacaaaggtggaagccaaggctcctgagacacccagcgagaacctcaggactggcctggaattggctccagcacccggcagggtcaatgtggtctccccgagcctggaggttgcaccaggtgcaggacaaggagcatcgtccagcaggcctgaccctgagcccttagaggaaggcacgaggctgactccagggcctggccctcagtgcccagggcctccagggctgccagcccaggccagggcaacccacagtggtggagaaacacctccaaggatctccatccacatacaagagatggatactcctggggagatgctgatgacaggcaggggcagccttggacccaccctcaccacagaggctccagcagctgcccagccaggcaagcagggcccacctgggaccgggcgctgcctccaagcccctgggactgagcccggagaacagacccctgaaggagccagagagctctccccgctgcaggagagcagcagccccgggggagtgaaggcagaggaggagcaaagggctggggccgagcctggcacgagaccaagcttggccaggagtgacgacaatgaccacgaggttggggccctgggcctgcagcagggcaaaagcccaggggcgggaaaccctgagcctgagcaggactgtgcagccagggctccggtgagagctgaagcagtaaggaggatgcccccaggcgccgaggctggcagcgtggttctggatgacagtccggccccaccagctccttttgaacaccgggtagtgagcgtcaaggagacctccatctctgcgggttacgaggtgtgccagcacgaagtcttgggagggggtcggtttggccaggtccacaggtgcacagagaagtccacaggcctcccactggctgccaagatcatcaaagtgaagagcgccaaggaccgggaggacgtgaagaacgagatcaacatcatgaaccagctcagccacgtgaacctgatccagctctatgacgccttcgagagcaagcacagctgcacccttgtcatggagtacgtggacgggggtgagctcttcgaccggatcacagatgagaagtaccacctgactgagctggatgtggtcctgttcaccaggcagatctgtgagggtgtgcattacctgcaccagcactacatcctgcacctggacctcaagccggagaacatattgtgcgtcaatcagacaggacatcaaattaagatcattgactttgggctggccagaaggtacaagcctcgagagaagctgaaggtgaacttcggcactcctgagttcctggccccagaagtcgtcaattatgagtttgtctcattccccacagacatgtggagtgtgggagtcatcacctacatgctactcagtggcttgtccccatttctaggggaaacagatgcagagaccatgaatttcattgtaaactgtagctgggattttgatgctgacacctttgaagggctctcggaggaggccaaggactttgtttcccggttgctggtcaaagagaagagctgcagaatgagtgccacacagtgcctgaaacacgagtggctgaataatttgcctgccaaagcttcaagatccaaaactcgtctcaaatcccaactactgctgcagaaatacatagctcaaagaaaatggaagaaacatttctatgtggtgactgctgccaacaggttaaggaaatttccaacttctccctaatcttcaactctgctgctccaatgggtccagaaattactgaggccagtggtgaagtgaagagatgactcaaacatttaaataatttggcttttggtattattgattccacttatttgtaaatggttatggctgctgcttcctgtggatgaaagtggctgtaagagctcctagacgtttctgctgt

SEQ ID NO: 370 - DNA, 3295 bp, Homo sapiens
tggagagggacaggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgtcgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatattaaaaaaaaaaaaaaaaaaaaa

SEQ ID NO: 371 - DNA, 1309 bp, Homo sapiens
ggacaggtgccccgggagcttcccgctcgcgaagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctgaaagcacttagcgggcgcgctgggatgtcacagagttggagtcattgttgggggaccgtgggccg

SEQ ID NO: 372 - DNA, 1931 bp, Homo sapiens
atgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagcaaaaaaa

SEQ ID NO: 373 - DNA, 2192 bp, Homo sapiens
ggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccgggggggacggaagccgcggccgggccaactccgaggcggggacgccgcgacgggaacttgaggtgggaactttgcgcgctgcagcctcgccgggcgccaccgaagcgcgaaccggaccccgagcctgcaaactcgggctcgggggcggctgcacgtggccgtggccctgaactccctgcgggggcctcgaaacccgcctgcggggaggccagggcgacagaggactcgggagtcaccgctggtgcgtggcggcgtggagcgcgcttgttacggccaagggagcaggctgcctaatgaaggagccaggcttgcacacagacaattctagaactggtggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcaggtaagagcccacgccccgcggggaaacgcgccaccacgagggaagggactctgagcattgtcacctcctccagaaagcctcctctgattgcacactggctgaatagcatccctggtccctcctgacatcaggaatgtttgtgtgcatggtctgcctccctgttaatatgtgagcatcatgggggtccacgcctgtgcctgtcctggcctccactgtgcccaccactgccctcccccttgccagtgtttagaacagtgtccagcacaaacaggcactcaaccactatttgttgaatgaacaaatgagtgaataaatgggtggtgtgatttttgacgtgcctggccctgagcgaagcacattacatatatcatcaaatttatctcaaccattcggtcctttctcaacgttcctaatcctttgcatcatagtagcccagacacattttctgggtcctgaagataatttttattgataggtacatgtgtgtctacaaatggtgagcatttctttttgttacataagagaatgaatggaaagtttatttactccagggcctgacacggggtgtgtgctacagtctaagggctcccactcatctgggagttcacgggagccggagctgggctgcatgtgccaactacgtcttatctccccagggaatgctccagcaaccctgtgggggaagtgttttcacacccactaggtatttgaggacactgcccaaccccaggtctaagtccagtctgtctttgtaagcatggaaatatggttcccacgtggcagcttggggacctaatatagccccacaggactatgtgattggcccacacaaggtttcccaaaaatttgacttggttgccaacaataaaagtgaagttttttcataaaaaaaaaaaaaaaaaaaaaa

SEQ ID NO: 374 - DNA, 3889 bp, Homo sapiens
gtccccctgctggggacagcagctgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcccaaaaaaaaaaaaaaaaaaaa

SEQ ID NO: 375 - DNA, 2667 bp, Homo sapiens
agtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgag

SEQ ID NO: 376 - DNA, 7618 bp, Homo sapiens
aagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcaggacaatggggaacactggaagtccctggagtctgtgggcatcagccgcaaagaactagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactatccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccaggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaaaaaaaaaaaaaaaaa

SEQ ID NO: 377 - protein, 175 aa, Homo sapiens
MTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 378 - protein, 686 aa, Homo sapiens
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 379 - protein, 370 aa, Homo sapiens
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 380 - protein, 1014 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAAIAALERVKIRPMEHCCCSVRIPCPSSPEELGKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 381 - protein, 1464 aa, Homo sapiens [sequence omitted]

SEQ ID NO: 382 - protein, 390 aa, Homo sapiens [sequence omitted]

SEQ ID NO: 383 - protein, 390 aa, Homo sapiens
MGRGARVPSEAPGAGVERRWLGAALVALCLLPALVLLARLGAPAVPAWSAAQGDVAALGLSAVPPTRVPGPLAPRRRRYTLTPARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGCLDRLFVCASWARRGFCDARRRLMKRLCPSSCDFCYEFPFPTVATTPPPPRTKTRLVPEGRNVTFRCGQKILHKKGKVYWYKDQEPLEFSYPGYLALGEAHLSIIANAVNEGTYTCVVRRQQRVLTTYSWRVRVRG

SEQ ID NO: 384 - protein, 355 aa, Homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 385 - protein, 394 aa, Homo sapiens
MGMKHSSRCLLLRRKMAENAAESTEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 386 - protein, 625 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSDIPSSTASLCSRKTGVENVMAKEICQKYLEKGAGRLPEDCAEALATAACLCLRRRNTSLQEVCGSVAAVEERLRGRETLLPWSGLSEGTGSSSNTPEETDDVDNSSLDASSSMSVAPWAGAATPLLPTENGEGRLRVIVGREADSSSEACVGLEPPQDVTETSWQIEINEAKRKLMENILLYKEEKVDSIELFGP

SEQ ID NO: 387 - protein, 590 aa, Homo sapiens [sequence omitted]

SEQ ID NO: 388 - protein, 1118 aa, Homo sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 389 - protein, 1206 aa, Homo sapiens
MEGAAAGQWAGRVGRPGFENDRARNGGGHGATAAQGARVRWSRRAGGAGGGARHGAERRAAAGWQRRAPAARAGTGGRGDEAAPGGASGQAGTRPAAPLGCAKSSRSALFSYRGNSAGEPALPALPARALPAAAVLGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 390 - protein, 414 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPELVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 391 - protein, 414 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 392 - protein, 465 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 393 - protein, 1235 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKVRAGQRPPGLPLPIPGALGPPNTGTPIEQQPCSPGQEAVLDQRMLGEEEEAVGERRILGKEGATLEPKQQRILGEESGAPSPSPQKHGSLVDEEVWGLPEEIEELRVPSLVPQERSIVGQEEAGTWSLWGKEDESLLDEEFELGWVQGPALTPVPEEEEEEEEGAPIGTPRDPGDGCPSPDIPPEPPPTHLRPCPASQLPGLLSHGLLAGLSFAVGSSSGLLPLLLLLLLPLLAAQGGGGLQAALLALEVGLVGLGASYLLLCTALHLPSSLFLLLAQGTALGAVLGLSWRRGLMGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 394 - protein, 1049 aa, Homo sapiens
MPAGGRAGSLKDPDVAELFFKDDPEKLFSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFVLRERPPTVIMDLIQRTKDAVRELDNLQYRKMKKILFQEAPNGPGAEAPEEEEEAEPYMHRAGTLTSLESSHSVPSMSISASSQSSSVNSLADASDNEEEEEEEEEEEEEEEGPEAREMAMMQEGEHTVTSHSSIIHRLPGSDNLYDDPYQPEITPSPLQPPAAPAPTSTTSSARRRAYCRNRDHFATIRTASLVSRQIQEHEQDSALREQLSGYKRMRRQHQKQLLALESRLRGEREEHSARLQRELEAQRAGFGAEAEKLARRHQAIGEKEARAAQAEERKFQQHILGQQKKELAALLEAQKRTYKLRKEQLKEELQENPSTPKREKAEWLLRQKEQLQQCQAEEEAGLLRRQRQYFELQCRQYKRKMLLARHSLDQDLLREDLNKKQTQKDLECALLLRQHEATRELELRQLQAVQRTRAELTRLQHQTELGNQLEYNKRREQELRQKHAAQVRQQPKSLKSKELQIKKQFQETCKIQTRQYKALRAHLLETTPKAQHKSLLKRLKEEQTRKLAILAEQYDQSISEMLSSQALRLDETQEAEFQALRQQLQQELELLNAYQSKIKIRTESQHERELRELEQRVALRRALLEQRVEEELLALQTGRSERIRSLLERQAREIEAFDAESMRLGFSSMALGGIPAEAAAQGYPAPPPAPAWPSRPVPRSGAHWSHGPPPPGMPPPAWRQPSLLAPPGPPNWLGPPTQSGTPRGGALLLLRNSPQPLRRAASGGSGSENVGPPAAAVPGPLSRSTSVASHILNGSSHFYS

SEQ ID NO: 395 - protein, 337 aa, Homo sapiens
MEKSWMLWNFVERWLIALASWSWALCRISLLPLIVTFHLYGGIILLLLIFISIAGILYKFQDVLLYFPEQPSSSRLYVPMPTGIPHENIFIRTKDGIRLNLILIRYTGDNSPYSPTIIYFHGNAGNIGHRLPNALLMLVNLKVNLLLVDYRGYGKSEGEASEEGLYLDSEAVLDYVMTRPDLDKTKIFLFGRSLGGAVAIHLASENSHRISAIMVENTFLSIPHMASTLFSFFPMRYLPLWCYKNKFLSYRKISQCRMPSLFISGLSDQLIPPVMMKQLYELSPSRTKRLAIFPDGTHNDTWQCQGYFTALEQFIKEVVKSHSPEEMAKTSSNVTII

SEQ ID NO: 396 - protein, 355 aa, Homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 397 - protein, 355 aa, Homo sapiens; identical to SEQ ID NO: 396

SEQ ID NO: 398 - protein, 422 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 399 - protein, 393 aa, Homo sapiens
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQSLRTVTAEHYDVNNSAIWHRGRGT

SEQ ID NO: 400 - protein, 384 aa, Homo sapiens
MKVTSLDGRQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPECCVDVKPISQEKIESERALISQCGKPVVNVSYRPAYDQGGPVEILPFLYLGSAYHASKCEFLANLHITALLNVSRRTSEACATHLHYKWIPVEDSHTADISSHFQEAIDFIDCVREKGGKVLVHCEAGISRSPTICMAYLMKTKQFRLKEAFDYIKQRRSMVSPNFGFMGQLLQYESEILPSTPNPQPPSCQGEAAGSSLIGHLQTLSPDMQGAYCTFPASVLAPVPTHSTVSELSRSPVATATSC

SEQ ID NO: 401 - protein, 231 aa, Homo sapiens
MFLVGLTGGIASGKSSVIQVFQQLGCAVIDVDVMARHVVQPGYPAHRRIVEVFGTEVLLENGDINRKVLGDLIFNQPDRRQLLIAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSVTKRQVILLHTELERSLEYLPLRFGVLTGLAAIASLLYLLTHYLLPYA

SEQ ID NO: 402 - protein, 305 aa, Homo sapiens
MDFLLVQLALADLYACGGTALSQLAWELLGEPRAATGDLACRFLQLLQASGRGASAHLVVLIALERRRAVRLPHGRPLPARALAALGWLLALLLALPPAFVVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 403 - protein, 434 aa, Homo sapiens
MEDLFSPSILPPAPNISVPILLGWGLNLTLGQGAPASGPPSRRVRLVFLGVILVVAVAGNTTVLCRLCGGGGPWAGPKRRKMDFLLVQLALADLYACGGTALSQLAWELLGEPRAATGDLACRFLQLLQASGRGASAHLVVLIALERRRAVRLPHGRPLPARALAALGWLLALLLALPPAFVVRGDSPSPLPPPPPPTSLQPGAPPAARAWPGERRCHGIFAPLPRWHLQVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 404 - protein, 264 aa, Homo sapiens
MTKFSSFSLFFLIVGAYMTHVCFNMEIIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWIKSNLVPPHTN

SEQ ID NO: 405 - protein, 309 aa, Homo sapiens
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISHPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 406 - protein, 309 aa, Homo sapiens
MKKENQSFNLDFILLGVTSQQEQNNVFFVIFLCIYPITLTGNLLIILAICADIRLHNPMYFLLANLSLVDIIFSSVTIPKVLANHLLGSKFISFGGCLMQMYFMIALAKADSYTLAAMAYDRAVAISCPLHYTTIMSPRSCILLIAGSWVIGNTSALPHTLLTASLSFCGNQEVANFYCDIMPLLKLSCSDVHFNVKMMYLGVGVFSLPLLCIIVSYVQVFSTVFQVPSTKSLFKAFCTCGSHLTVVFLYYGTTMGMYFRPLTSYSPKDAVITVMYVAVTPALNPFIYSLRNWDMKAALQKLFSKRISS

SEQ ID NO: 407 - protein, 281 aa, Homo sapiens
MKLAAMIKKMCPSDSELSIPAKNCYRMVILGSSKVGKTAIVSRFLTGRFEDAYTPTIEDFHRKFYSIRGEVYQLDILDTSGNHPFPAMRRLSILTGDVFILVFSLDNRDSFEEVQRLRQQILDTKSCLKNKTKENVDVPLVICGNKGDRDFYREVDQREIEQLVGDDPQRCAYFEISAKKNSSLDQMFRALFAMAKLPSEMSPDLHRKVSVQYCDVLHKKALRNKKLLRAGSGGGGGDPGDAFGIVAPFARRPSVHSDLMYIREKASAGSQAKDKERCVIS

SEQ ID NO: 408 - protein, 465 aa, Homo sapiens
MGGAVVDEGPTGVKAPDGGWGWAVLFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 409 - protein, 424 aa, Homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 410 - protein, 898 aa, Homo sapiens
MSGTSKESLGHGGLPGLGKTCLTTMDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEEWVKEEEVCFMPPVPPAPGAAGQSLQKDKGELSAEQGIWATLMTLVIMVTAANKERVEEEGGKPKHVLSTSGVQSDAREPGEESQKADVLEGTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRAALLKGAVAPGFSRRDLVFPSIFCACLGISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 411 - protein, 795 aa, Homo sapiens
MDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGLQSDAREPGEESQKADVLERTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 412 - protein, 514 aa, Homo sapiens
MSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 413 - protein, 387 aa, Homo sapiens
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 414 - protein, 513 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 415 - protein, 275 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQVRAHAPRGNAPPRGKGL

SEQ ID NO: 416 - protein, 681 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 417 - protein, 681 aa, Homo sapiens; identical to SEQ ID NO: 416

SEQ ID NO: 418 - protein, 1634 aa, Homo sapiens
MSSTQDNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 419 - protein, 236 aa, Homo sapiens
HDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 420 - protein, 41 aa, Homo sapiens
MGDRRFIDFQFQDSNSSLRPRLGNATANNTCIVDDSFKYNL

SEQ ID NO: 421 - protein, 23 aa, Homo sapiens
NGAVYSVVFILGLITNSVSLFVF

SEQ ID NO: 422 - protein, 11 aa, Homo sapiens
CFRMKMRSETA

SEQ ID NO: 423 - protein, 23 aa, Homo sapiens
IFITNLAVSDLLFVCTLPFKIFY

SEQ ID NO: 424 - protein, 14 aa, Homo sapiens
NFNRHWPFGDTLCK

SEQ ID NO: 425 - protein, 22 aa, Homo sapiens
ISGTAFLTNIYGSMLFLTCISV

SEQ ID NO: 426 - protein, 20 aa, Homo sapiens
DRFLAIVYPFRSRTIRTRRN

SEQ ID NO: 427 - protein, 23 aa, Homo sapiens
SAIVCAGVWILVLSGGISASLFS

SEQ ID NO: 428 - protein, 28 aa, Homo sapiens
TTNVNNATTTCFEGFSKRVWKTYLSKIT

SEQ ID NO: 429 - protein, 23 aa, Homo sapiens
IFIEVVGFIIPLILNVSCSSVVL

SEQ ID NO: 430 - protein, 25 aa, Homo sapiens
RTLRKPATLSQIGTNKKKVLKMITV

SEQ ID NO: 431 - protein, 23 aa, Homo sapiens
HMAVFVVCFVPYNSVLFLYALVR

SEQ ID NO: 432 - protein, 14 aa, Homo sapiens
SQAITNCFLERFAK

SEQ ID NO: 433 - protein, 23 aa, Homo sapiens
IMYPITLCLATLNCCFDPFIYYF

SEQ ID NO: 434 - protein, 57 aa, Homo sapiens
TLESFQKSFYINAHIRMESLFKTETPLTTKPSLPAIQEEVSDQTTNNGGELMLESTF

SEQ ID NO: 435 - protein, 626 aa, Homo sapiens
MVFSVRQCGHVGRTEEVLLTFKIFLVIICLHVVLVTSLEEDTDNSSLSPPPAKLSVVSFAPSSNEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAAIAALERVKIRPMEHCCCSVRIPCPSSPEELGKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALT

SEQ ID NO: 436 - protein, 22 aa, Homo sapiens
FITYIGCGLSSIFLSVTLVTYI

SEQ ID NO: 437 - protein, 12 aa, Homo sapiens
AFEKIRRDYPSK

SEQ ID NO: 438 - protein, 23 aa, Homo sapiens
ILIQLCAALLLLNLVFLLDSWIA

SEQ ID NO: 439 - protein, 12 aa, Homo sapiens
LYKMQGLCISVA

SEQ ID NO: 440 - protein, 23 aa, Homo sapiens
VFLHYFLLVSFTWMGLEAFHMYL

SEQ ID NO: 441 - protein, 12 aa, Homo sapiens
ALVKVFNTYIRK

SEQ ID NO: 442 - protein, 23 aa, Homo sapiens
YILKFCIVGWGVPAVVVTIILTI

SEQ ID NO: 443 - protein, 31 aa, Homo sapiens
SPDNYGLGSYGKFPNGSPDDFCWINNNAVFY

SEQ ID NO: 444 - protein, 23 aa, Homo sapiens
ITVVGYFCVIFLLNVSMFIVVLV

SEQ ID NO: 445 - protein, 23 aa, Homo sapiens
QLCRIKKKKQLGAQRKTSIQDLR

SEQ ID NO: 446 - protein, 23 aa, Homo sapiens
SIAGLTFLLGITWGFAFFAWGPV

SEQ ID NO: 447 - protein, 3 aa, Homo sapiens
NVT

SEQ ID NO: 448 - protein, 23 aa, Homo sapiens
FMYLFAIFNTLQGFFIFIFYCVA

SEQ ID NO: 449 - protein, 135 aa, Homo sapiens
KENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 450 - protein, 285 aa, Homo sapiens
SASVWVMMFVMLLIVSAIAVFVFEYFSPVGYNRNLAKGKAPHGPSFTIGKAIWLLWGLVFNNSVPVQNPKGTTSKIMVSVWAFFAVIFLASYTANLAAFMIQEEFVDQVTGLSDKKFQRPHDYSPPFRFGTVPNGSTERNIRNNYPYMHQYMTKFNQKGVEDALVSLKTGKLDAFIYDAAVLNYKAGRDEGCKLVTIGSGYIFATTGYGIALQKGSPWKRQIDLALLQFVGDGEMEELETLWLTGICHNEKNEVMSSQLDIDNMAGVFYMLAAAMALSLITFIWE

SEQ ID NO: 451 - protein, 172 aa, Homo sapiens
ARLRWDHLNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGC

SEQ ID NO: 452 - protein, 168 aa, Homo sapiens
RWDHLNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYG

SEQ ID NO: 453 - protein, 37 aa, Homo sapiens
GCLDRLFVCASWARRGFCDARRRLMKRLCPSSCDFCY

SEQ ID NO: 454 - protein, 83 aa, Homo sapiens
KTRLVPEGRNVTFRCGQKILHKKGKVYWYKDQEPLEFSYPGYLALGEAHLSIIANAVNEGTYTCVVRRQQRVLTTYSWRVRVR

SEQ ID NO: 455 - protein, 172 aa, Homo sapiens
ARLRWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYGC

SEQ ID NO: 456 - protein, 168 aa, Homo sapiens
RWDHFNLTYRILSFPRNLLSPRETRRALAAAFRMWSDVSPFSFREVAPEQPSDLRIGFYPINHTDCLVSALHHCFDGPTGELAHAFFPPHGGIHFDDSEYWVLGPTRYSWKKGVWLTDLVHVAAHEIGHALGLMHSQHGRALMHLNATLRGWKALSQDELWGLHRLYG

SEQ ID NO: 457 - protein, 37 aa, Homo sapiens; identical to SEQ ID NO: 453

SEQ ID NO: 458 - protein, 83 aa, Homo sapiens; identical to SEQ ID NO: 454

SEQ ID NO: 459 - protein, 36 aa, Homo sapiens
METPNTTEDYDTTTEFDYGDATPCQKVNERAFGAQL

SEQ ID NO: 460 - protein, 23 aa, Homo sapiens
LPPLYSLVFVIGLVGNILVVLVL

SEQ ID NO: 461 - protein, 11 aa, Homo sapiens
VQYKRLKNMTS

SEQ ID NO: 462 - protein, 23 aa, Homo sapiens
IYLLNLAISDLLFLFTLPFWIDY

SEQ ID NO: 463 - protein, 14 aa, Homo sapiens
KLKDDWVFGDAMCK

SEQ ID NO: 464 - protein, 20 aa, Homo sapiens
ILSGFYYTGLYSEIFFIILL

SEQ ID NO: 465 - protein, 19 aa, Homo sapiens
TIDRYLAIVHAVFALRART

SEQ ID NO: 466 - protein, 23 aa, Homo sapiens
VTFGVITSIIIWALAILASMPGL

SEQ ID NO: 467 - protein, 35 aa, Homo sapiens
YFSKTQWEFTHHTCSLHFPHESLREWKLFQALKLN

SEQ ID NO: 468 - protein, 23 aa, Homo sapiens
LFGLVLPLLVMIICYTGIIKILL

SEQ ID NO: 469 - protein, 12 aa, Homo sapiens
RRPNEKKSKAVR

SEQ ID NO: 470 - protein, 23 aa, Homo sapiens
LIFVIMIIFFLFWTPYNLTILIS

SEQ ID NO: 471 - protein, 19 aa, Homo sapiens
VFQDFLFTHECEQSRHLDL

SEQ ID NO: 472 - protein, 23 aa, Homo sapiens
AVQVTEVIAYTHCCVNPVIYAFV

SEQ ID NO: 473 - protein, 51 aa, Homo sapiens
GERFRKYLRQLFHRRVAVHLVKWLPFLSVDRLERVSSTSPSTGEHELSAGF

SEQ ID NO: 474 - protein, 134 aa, Homo sapiens
VNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLD

SEQ ID NO: 475 - protein, 81 aa, Homo sapiens
DDLCRNMDALSEWDWMEFASYVITDLTQLRKIKSMERVQGVSITRELLWWWGMRQATVQQLVDLLCRLELYRAAQIILNWK

SEQ ID NO: 476 - protein, 143 aa, Homo sapiens
FNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLA

SEQ ID NO: 477 - protein, 60 aa, Homo sapiens
PYWTAVFEYEAAGEDELTLRLGDVVEVLSKDSQVSGDEGWWTGQLNQRVGIFPSNYVTPR

SEQ ID NO: 478 - protein, 260 aa, Homo sapiens
LTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQL

SEQ ID NO: 479 - protein, 286 aa, Homo sapiens
YQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPELVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWV

SEQ ID NO: 480 - protein, 286 aa, Homo sapiens
YQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWV

SEQ ID NO: 481 - protein, 254 aa, Homo sapiens
FSDLREIGHGSFGAVYFARDVRNSEVVAIKKMSYSGKQSNEKWQDIIKEVRFLQKLRHPNTIQYRGCYLREHTAWLVMEYCLGSASDLLEVHKKPLQEVEIAAVTHGALQGLAYLHSHNMIHRDVKAGNILLSEPGLVKLGDFGSASIMAPANSFVGTPYWMAPEVILAMDEGQYDGKVDVWSLGITCIELAERKPPLFNMNAMSALYHIAQNESPVLQSGHWSEYFRNFVDSCLQKIPQDRPTSEVLLKHRFV

SEQ ID NO: 482 - protein, 101 aa, Homo sapiens
NLLLVDYRGYGKSEGEASEEGLYLDSEAVLDYVMTRPDLDKTKIFLFGRSLGGAVAIHLASENSHRISAIMVENTFLSIPHMASTLFSFFPMRYLPLWCYK

SEQ ID NO: 483 - protein, 251 aa, Homo sapiens
GNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIY

SEQ ID NO: 484 - protein, 36 aa, Homo sapiens
MTTSLDTVETFGTTSYYDDVGLLCEKADTRALMAQF

SEQ ID NO: 485 - protein, 23 aa, Homo sapiens
VPPLYSLVFTVGLLGNVVVVMIL

SEQ ID NO: 486 - protein, 12 aa, Homo sapiens
IKYRRLRIMTNI

SEQ ID NO: 487 - protein, 23 aa, Homo sapiens
YLLNLAISDLLFLVTLPFWIHYV

SEQ ID NO: 488 - protein, 25 aa, Homo sapiens
RGHNWVFGHGMCKLLSGFYHTGLYS

SEQ ID NO: 489 - protein, 23 aa, Homo sapiens
EIFFIILLTIDRYLAIVHAVFAL

SEQ ID NO: 490 - protein, 6 aa, Homo sapiens
RARTVT

SEQ ID NO: 491 - protein, 23 aa, Homo sapiens
FGVITSIVTWGLAVLAALPEFIF

SEQ ID NO: 492 - protein, 33 aa, Homo sapiens
YETEELFEETLCSALYPEDTVYSWRHFHTLRMT

SEQ ID NO: 493 - protein, 23 aa, Homo sapiens
IFCLVLPLLVMAICYTGIIKTLL

SEQ ID NO: 494 - protein, 12 aa, Homo sapiens
RCPSKKKYKAIR

SEQ ID NO: 495 - protein, 23 aa, Homo sapiens
LIFVIMAVFFIFWTPYNVAILLS

SEQ ID NO: 496 - protein, 19 aa, Homo sapiens
SYQSILFGNDCERSKHLDL

SEQ ID NO: 497 - protein, 23 aa, Homo sapiens
VMLVTEVIAYSHCCMNPVIYAFV

SEQ ID NO: 498 - protein, 51 aa, Homo sapiens
GERFRKYLRHFFHRHLLMHLGRYIPFLPSEKLERTSSVSPSTAEPELSIVF

SEQ ID NO: 499 - protein, 237 aa, Homo sapiens
FRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCE

SEQ ID NO: 500 - protein, 130 aa, Homo sapiens
RQLRKMLRKEAAARCVVLDCRPYLAFAASNVRGSLNVNLNSVVLRRARGGAVSARYVLPDEAARARLLQEGGGGVAAVVVLDQGSRHWQKLREESAARVVLTSLLACLPAGPRVYFLKGGYETFYSEYPE

SEQ ID NO: 501 - protein, 139 aa, Homo sapiens
GPVEILPFLYLGSAYHASKCEFLANLHITALLNVSRRTSEACATHLHYKWIPVEDSHTADISSHFQEAIDFIDCVREKGGKVLVHCEAGISRSPTICMAYLMKTKQFRLKEAFDYIKQRRSMVSPNFGFMGQLLQYESE

SEQ ID NO: 502 - protein, 183 aa, Homo sapiens
FLVGLTGGIASGKSSVIQVFQQLGCAVIDVDVMARHVVQPGYPAHRRIVEVFGTEVLLENGDINRKVLGDLIFNQPDRRQLLIAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSV

SEQ ID NO: 503 - protein, 82 aa, Homo sapiens
MDFLLVQLALADLYACGGTALSQLAWELLGEPRAATGDLACRFLQLLQASGRGASAHLVVLIALERRRAVRLPHGRPLPARA

SEQ ID NO: 504 - protein, 23 aa, Homo sapiens
LAALGWLLALLLALPPAFVVYAF

SEQ ID NO: 505 - protein, 3 aa, Homo sapiens
YEA

SEQ ID NO: 506 - protein, 23 aa, Homo sapiens
VAGFVAPVTVLGVACGHLLSVWW

SEQ ID NO: 507 - protein, 37 aa, Homo sapiens
RHRPQAPAAAAPWSASPGRAPAPSALPRAKVQSLKMS

SEQ ID NO: 508 - protein, 23 aa, Homo sapiens
LLLALLFVGCELPYFAARLAAAW

SEQ ID NO: 509 - protein, 14 aa, Homo sapiens
SSGPAGDWEGEGLS

SEQ ID NO: 510 - protein, 23 aa, Homo sapiens
AALRVVAMANSALNPFVYLFFQA

SEQ ID NO: 511 - protein, 77 aa, Homo sapiens
GDCRLRRQLRKRLGSLCCAPQGGAEDEEGPRGHQALYRQRWPHPHYHHARREPLDEGGLRPPPPRPRPLPCSCESAF

SEQ ID NO: 512 - protein, 47 aa, Homo sapiens
MEDLFSPSILPPAPNISVPILLGWGLNLTLGQGAPASGPPSRRVRLV

SEQ ID NO: 513 - protein, 23 aa, Homo sapiens
FLGVILVVAVAGNTTVLCRLCGG

SEQ ID NO: 514 - protein, 90 aa, Homo sapiens
GGPWAGPKRRKMDFLLVQLALADLYACGGTALSQLAWELLGEPRAATGDLACRFLQLLQASGRGASAHLVVLIALERRRAVRLPHGRPLP

SEQ ID NO: 515 - protein, 23 aa, Homo sapiens
ARALAALGWLLALLLALPPAFVV

SEQ ID NO: 516 - protein, 53 aa, Homo sapiens
RGDSPSPLPPPPPPTSLQPGAPPAARAWPGERRCHGIFAPLPRWHLQVYAFYE

SEQ ID NO: 517 - protein, 23 aa, Homo sapiens
AVAGFVAPVTVLGVACGHLLSVW

SEQ ID NO: 518 - protein, 38 aa, Homo sapiens
WRHRPQAPAAAAPWSASPGRAPAPSALPRAKVQSLKMS

SEQ ID NO: 519 - protein, 23 aa, Homo sapiens
LLLALLFVGCELPYFAARLAAAW

SEQ ID NO: 520 - protein, 14 aa, Homo sapiens
SSGPAGDWEGEGLS

SEQ ID NO: 521 - protein, 23 aa, Homo sapiens
AALRVVAMANSALNPFVYLFFQA

SEQ ID NO: 522 - protein, 77 aa, Homo sapiens; identical to SEQ ID NO: 511

SEQ ID NO: 523 - protein, 228 aa, Homo sapiens
IIGGKEVSPHSRPFMASIQYGGHHVCGGVLIDPQWVLTAAHCQYRFTKGQSPTVVLGAHSLSKNEASKQTLEIKKFIPFSRVTSDPQSNDIMLVKLQTAAKLNKHVKMLHIRSKTSLRSGTKCKVTGWGATDPDSLRPSDTLREVTVTVLSRKLCNSQSYYNGDPFITKDMVCAGDAKGQKDSCKGDSGGPLICKGVFHAIVSGGHECGVATKPGIYTLLTKKYQTWI

SEQ ID NO: 524 - protein, 25 aa, Homo sapiens
MRENNQSSTLEFILLGVTGQQEQED

SEQ ID NO: 525 - protein, 23 aa, Homo sapiens
FFYILFLFIYPITLIGNLLIVLA

SEQ ID NO: 526 - protein, 12 aa, Homo sapiens
ICSDVRLHNPMY

SEQ ID NO: 527 - protein, 23 aa, Homo sapiens
FLLANLSLVDIFFSSVTIPKMLA

SEQ ID NO: 528 - protein, 14 aa, Homo sapiens
NHLLGSKSISFGGC

SEQ ID NO: 529 - protein, 23 aa, Homo sapiens
LTQMYFMIALGNTDSYILAAMAY

SEQ ID NO: 530 - protein, 19 aa, Homo sapiens
DRAVAISHPLHYTTIMSPR

SEQ ID NO: 531 - protein, 23 aa, Homo sapiens
SCIWLIAGSWVIGNANALPHTLL

SEQ ID NO: 532 - protein, 36 aa, Homo sapiens
TASLSFCGNQEVANFYCDITPLLKLSCSDIHFHVKM

SEQ ID NO: 533 - protein, 23 aa, Homo sapiens
MYLGVGIFSVPLLCIIVSYIRVF

SEQ ID NO: 534 - protein, 11 aa, Homo sapiens
STVFQVPSTKG

SEQ ID NO: 535 - protein, 23 aa, Homo sapiens
VLKAFSTCGSHLTVVSLYYGTVM

SEQ ID NO: 536 - protein, 14 aa, Homo sapiens
GTYFRPLTNYSLKD

SEQ ID NO: 537 - protein, 23 aa, Homo sapiens
AVITVMYTAVTPMLNPFIYSLRN

SEQ ID NO: 538 - protein, 17 aa, Homo sapiens
RDMKAALRKLFNKRISS

SEQ ID NO: 539 - protein, 25 aa, Homo sapiens
MKKENQSFNLDFILLGVTSQQEQNN

SEQ ID NO: 540 - protein, 23 aa, Homo sapiens
VFFVIFLCIYPITLTGNLLIILA

SEQ ID NO: 541 - protein, 12 aa, Homo sapiens
ICADIRLHNPMY

SEQ ID NO: 542 - protein, 23 aa, Homo sapiens
FLLANLSLVDIIFSSVTIPKVLA

SEQ ID NO: 543 - protein, 24 aa, Homo sapiens
NHLLGSKFISFGGCLMQMYFMIAL

SEQ ID NO: 544 - protein, 13 aa, Homo sapiens
AKADSYTLAAMAY

SEQ ID NO: 545 - protein, 19 aa, Homo sapiens
DRAVAISCPLHYTTIMSPR

SEQ ID NO: 546 - protein, 23 aa, Homo sapiens
SCILLIAGSWVIGNTSALPHTLL

SEQ ID NO: 547 - protein, 36 aa, Homo sapiens
TASLSFCGNQEVANFYCDIMPLLKLSCSDVHFNVKM

SEQ ID NO: 548 - protein, 23 aa, Homo sapiens
MYLGVGVFSLPLLCIIVSYVQVF

SEQ ID NO: 549 - protein, 11 aa, Homo sapiens
STVFQVPSTKS

SEQ ID NO: 550 - protein, 23 aa, Homo sapiens
LFKAFCTCGSHLTVVFLYYGTTM

SEQ ID NO: 551 - protein, 14 aa, Homo sapiens
GMYFRPLTSYSPKD

SEQ ID NO: 552 - protein, 23 aa, Homo sapiens
AVITVMYVAVTPALNPFIYSLRN

SEQ ID NO: 553 - protein, 17 aa, Homo sapiens
WDMKAALQKLFSKRISS

SEQ ID NO: 554 - protein, 177 aa, Homo sapiens
KNCYRMVILGSSKVGKTAIVSRFLTGRFEDAYTPTIEDFHRKFYSIRGEVYQLDILDTSGNHPFPAMRRLSILTGDVFILVFSLDNRDSFEEVQRLRQQILDTKSCLKNKTKENVDVPLVICGNKGDRDFYREVDQREIEQLVGDDPQRCAYFEISAKKNSSLDQMFRALFAMAKLP

SEQ ID NO: 555 - protein, 355 aa, Homo sapiens
LFGCFVITGFSYAFPKAVSVFFKELIQEFGIGYSDTAWISSILLAMLYGTGPLCSVCVNRFGCRPVMLVGGLFASLGMVAASFCRSIIQVYLTTGVITGLGLALNFQPSLIMLNRYFSKRRPMANGLAAAGSPVFLCALSPLGQLLQDRYGWRGGFLILGGLLLNCCVCAALMRPLVVTAQPGSGPPRPSRRLLDLSVFRDRGFVLYAVAASVMVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGPPSGGKLLD

SEQ ID NO: 556 - protein, 37 aa, Homo sapiens
MDSGPLWDANPTPRGTLSAPNATTPWLGRDEELAKVE

SEQ ID NO: 557 - protein, 23 aa, Homo sapiens
IGVLATVLVLATGGNLAVLLTLG

SEQ ID NO: 558 - protein, 11 aa, Homo sapiens
QLGRKRSRMHL

SEQ ID NO: 559 - protein, 23 aa, Homo sapiens
FVLHLALTDLAVALFQVLPQLLW

SEQ ID NO: 560 - protein, 19 aa, Homo sapiens
DITYRFQGPDLLCRAVKYL

SEQ ID NO: 561 - protein, 23 aa, Homo sapiens
QVLSMFASTYMLLAMTLDRYLAV

SEQ ID NO: 562 - protein, 12 aa, Homo sapiens
CHPLRSLQQPGQ

SEQ ID NO: 563 - protein, 23 aa, Homo sapiens
STYLLIAAPWLLAAIFSLPQVFI

SEQ ID NO: 564 - protein, 28 aa, Homo sapiens
FSLREVIQGSGVLDCWADFGFPWGPRAY

SEQ ID NO: 565 - protein, 23 aa, Homo sapiens
LTWTTLAIFVLPVTMLTACYSLI

SEQ ID NO: 566 - protein, 61 aa, Homo sapiens
CHEICKNLKVKTQAWRVGGGGWRTWDRPSPSTLAATTRGLPSRVSSINTISRAKIRTVKMT

SEQ ID NO: 567 - protein, 23 aa, Homo sapiens
FVIVLAYIACWAPFFSVQMWSVW

SEQ ID NO: 568 - protein, 9 aa, Homo sapiens
DKNAPDEDS

SEQ ID NO: 569 - protein, 23 aa, Homo sapiens
TNVAFTISMLLGNLNSCCNPWIY

SEQ ID NO: 570 - protein, 86 aa, Homo sapiens
MGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 571 - protein, 256 aa, Homo sapiens
VCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWL

SEQ ID NO: 572 - protein, 256 aa, Homo sapiens; identical to SEQ ID NO: 571

SEQ ID NO: 573 - protein, 456 aa, Homo sapiens
LPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQ

SEQ ID NO: 574 - protein, 27 aa, Homo sapiens
MNVSGCPGAGNASQAGGGGGWHPEAVI

SEQ ID NO: 575 - protein, 23 aa, Homo sapiens
VPLLFALIFLVGTVGNTLVLAVL

SEQ ID NO: 576 - protein, 12 aa, Homo sapiens
LRGGQAVSTTNL

SEQ ID NO: 577 - protein, 23 aa, Homo sapiens
FILNLGVADLCFILCCVPFQATI

SEQ ID NO: 578 - protein, 14 aa, Homo sapiens
YTLDGWVFGSLLCK

SEQ ID NO: 579 - protein, 22 aa, Homo sapiens
AVHFLIFLTMHASSFTLAAVSL

SEQ ID NO: 580 - protein, 20 aa, Homo sapiens
DRYLAIRYPLHSRELRTPRN

SEQ ID NO: 581 - protein, 23 aa, Homo sapiens
ALAAIGLIWGLSLLFSGPYLSYY

SEQ ID NO: 582 - protein, 21 aa, Homo sapiens
RQSQLANLTVCHPAWSAPRRR

SEQ ID NO: 583 - protein, 22 aa, Homo sapiens
AMDICTFVFSYLLPVLVLGLTY

SEQ ID NO: 584 - protein, 30 aa, Homo sapiens
ARTLRYLWRAVDPVAAGSGARRAKRKVTRM

SEQ ID NO: 585 - protein, 23 aa, Homo sapiens
ILIVAALFCLCWMPHHALILCVW

SEQ ID NO: 586 - protein, 14 aa, Homo sapiens
FGQFPLTRATYALR

SEQ ID NO: 587 - protein, 21 aa, Homo sapiens
ILSHLVSYANSCVNPIVYALV

SEQ ID NO: 588 - protein, 92 aa, Homo sapiens
SKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 589 - protein, 99 aa, Homo sapiens
IINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGC

SEQ ID NO: 590 - protein, 193 aa, Homo sapiens
NVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSI

SEQ ID NO: 591 - protein, 99 aa, Homo sapiens; identical to SEQ ID NO: 589

SEQ ID NO: 592 - protein, 57 aa, Homo sapiens
EISAPQNFQHRVHTSFDPKEGKFVGLPPQWQNILDTLRRPKPVVDPSRITRVQLQPM

SEQ ID NO: 593 - protein, 252 aa, Homo sapiens
LDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFL

SEQ ID NO: 594 - protein, 103 aa, Homo sapiens
AVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKV

SEQ ID NO: 595 - protein, 141 aa, Homo sapiens
SYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTS

SEQ ID NO: 596 - protein, 187 aa, Homo sapiens
RYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFN

SEQ ID NO: 597 - protein, 263 aa, Homo sapiens
RVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQM

SEQ ID NO: 598 - protein, 113 aa, Homo sapiens
GRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPL

SEQ ID NO: 599 - protein, 90 aa, Homo sapiens
LFIMVMHIRGLQLLQDGNDPDPYVKIYLLPDPQKTTKRKTKVARKTCNPTYNEMLVYDGIPKGDLQQRELQLSVLSEQGFWENVLLGEVN

SEQ ID NO: 600 - DNA, 6401 bp, Homo sapiens
caaggcggccggcggcgaccatggcagcgggccggcggcggccgtagtggcccaggcctgggcttcagcctcccggggccccagagggcggggcggtccgggccgcggcggtggcggcgccacttccctgctcccgcccgaggactcctgcgggcactcgctgaggaccagcggaccggcggcgcgaatctgactgaggggcggggacgccgtctgttccccgccgctcccggcagggccgggccgggctgggccgggctgggccgggcgggcccctgggagcagcccccaggcgggggaccgccttggagacccgaagccggagctagaggcaggcggtgggcccgggtggagtcccggccggagctggtggttcgggggcggtgctaggccccgaggctgcgggacctgagcgcgaggagcctgagtgcgggtccagcggtggcggcatgagccggcccccgccgacggggaaaatgcccggcgcccccgagaccgcgccgggggacggggcaggcgcgagccgccagaggaagctggaggcgctgatccgagaccctcgctcccccatcaacgtggagagcttgctggatggcttaaattccttggtccttgatttagattttcctgctttgaggaaaaacaagaacatagataatttcttaaatagatatgagaaaattgtgaaaaaaatcagaggtctacagatgaaggcagaagactatgatgttgtaaaagttattggaagaggtgcttttggtgaagtgcagttggttcgtcacaaggcatcgcagaaggtttatgctatgaagcttcttagtaagtttgaaatgataaaaagatcagattctgcctttttttgggaagaaagagatattatggcctttgccaatagcccctgggtggttcagcttttttatgcctttcaagatgataggtatctgtacatggtaatggagtacatgcctggtggagaccttgtaaaccttatgagtaattatgatgtgcctgaaaaatgggccaaattttacactgctgaagttgttcttgctctggatgcaatacactccatgggtttaatacacagagatgtgaagcctgacaacatgctcttggataaacatggacatctaaaattagcagattttggcacgtgtatgaagatggatgaaacaggcatggtacattgtgatacagcagttggaacaccggattatatatcacctgaggttctgaaatcacaagggggtgatggtttctatgggcgagaatgtgattggtggtctgtaggtgttttcctttatgagatgctagtgggggatactccattttatgcggattcacttgtaggaacatatagcaaaattatggatcataagaattcactgtgtttccctgaagatgcagaaatttccaaacatgcaaagaatctcatctgtgctttcttaacagatagggaggtacgacttgggagaaatggggtggaagaaatcagacagcatcctttctttaagaatgatcagtggcattgggataacataagagaaacggcagctcctgtagtacctgaactcagcagtgacatagacagcagcaatttcgatgacattgaagatgacaaaggagatgtagaaaccttcccaattcctaaagcttttgttggaaatcagctgcctttcatcggatttacctactatagagaaaatttattattaagtgactctccatcttgtagagaaactgattccatacaatcaaggaaaaatgaagaaagtcaagagattcagaaaaaactgtatacattagaagaacatcttagcaatgagatgcaagccaaagaggaactggaacagaagtgcaaatctgttaatactcgcctagaaaaaacagcaaaggagctagaagaggagattaccttacggaaaagtgtggaatcagcattaagacagttagaaagagaaaaggcgcttcttcagcacaaaaatgcagaatatcagaggaaagctgatcatgaagcagacaaaaaacgaaatttggaaaatgatgttaacagcttaaaagatcaacttgaagatttgaaaaaaagaaatcaaaactctcaaatatccactgagaaagtgaatcaactccagagacaactggatgaaaccaatgctttactgcgaacagagtctgatactgcagcccggttaaggaaaacccaggcagaaagttcaaaacagattcagcagctggaatctaacaatagagatctacaagataaaaactgcctgctggagactgccaagttaaaacttgaaaaggaatttatcaatcttcagtcagctctagaatctgaaaggagggatcgaacccatggatcagagataattaatgatttacaaggtagaatatgtggcctagaagaagatttaaagaacggcaaaatcttactagcgaaagtagaactggagaagagacaacttcaggagagatttactgatttggaaaaggaaaaaagcaacatggaaatagatatgacataccaactaaaagttatacagcagagcctagaacaagaagaagctgaacataaggccacaaaggcacgactagcagataaaaataagatctatgagtccatcgaagaagccaaatcagaagccatgaaagaaatggagaagaagctcttggaggaaagaactttaaaacagaaagtggagaacctattgctagaagctgagaaaagatgttctctattagactgtgacctcaaacagtcacagcagaaaataaatgagctccttaaacagaaagatgtgctaaatgaggatgttagaaacctgacattaaaaatagagcaagaaactcagaagcgctgccttacacaaaatgacctgaagatgcaaacacaacaggttaacacactaaaaatgtcagaaaagcagttaaagcaagaaaataaccatctcatggaaatgaaaatgaacttggaaaaacaaaatgctgaacttcgaaaagaacgtcaggatgcagatgggcaaatgaaagagctccaggatcagctcgaagcagaacagtatttctcaaccctttataaaacacaagttagggagcttaaagaagaatgtgaagaaaagaccaaacttggtaaagaattgcagcagaagaaacaggaattacaggatgaacgggactctttggctgcccaactggagatcaccttgaccaaagcagattctgagcaactggctcgttcaattgctgaagaacaatattctgatttggaaaaagagaagatcatgaaagagctggagatcaaagagatgatggctagacacaaacaggaacttacggaaaaagatgctacaattgcttctcttgaggaaactaataggacactaactagtgatgttgccaatcttgcaaatgagaaagaagaattaaataacaaattgaaagatgttcaagagcaactgtcaagattgaaagatgaagaaataagcgcagcagctattaaagcacagtttgagaagcagctattaacagaaagaacactcaaaactcaagctgtgaataagttggctgagatcatgaatcgaaaagaacctgtcaagcgtggtaatgacacagatgtgcggagaaaagagaaggagaatagaaagctacatatggagcttaaatctgaacgtgagaaattgacccagcagatgatcaagtatcagaaagaactgaatgaaatgcaggcacaaatagctgaagagagccagattcgaattgaactgcagatgacattggacagtaaagacagtgacattgagcagctgcggtcacaactccaagccttgcatattggtctggatagttccagtataggcagtggaccaggggatgctgaggcagatgatgggtttccagaatcaagattagaaggatggctttcattgcctgtacgaaacaacactaagaaatttggatgggttaaaaagtatgtgattgtaagcagtaagaagattcttttctatgacagtgaacaagataaagaacaatccaatccttacatggttttagatatagacaagttatttcatgtccgaccagttacacagacagatgtgtatagagcagatgctaaagaaattccaaggatattccagattctgtatgccaatgaaggagaaagtaagaaggaacaagaatttccagtggagccagttggagaaaaatctaattatatttgccacaagggacatgagtttattcctactctttatcatttcccaaccaactgtgaggcttgtatgaagcccctgtggcacatgtttaagcctcctcctgctttggagtgccgccgttgccatattaagtgtcataaagatcatatggacaaaaaggaggagattatagcaccttgcaaagtatattatgatatttcaacggcaaagaatctgttattactagcaaattctacagaagagcagcagaagtgggttagtcggttggtgaaaaagatacctaaaaagcccccagctccagacccttttgcccgatcatctcctagaacttcaatgaagatacagcaaaaccagtctattagacggccaagtcgacagcttgccccaaacaaacctagctaactgccttctatgaaagcagtcattattcaaggtgatcgtattcttccagtgaaaacaagactgaaatatgatggcccaaaatttattaaaaagctatattttcctgagagactgatacatacactcatacatatatgtgttccccttttccctgtaatataaattacaaatctgggctcctttgaagcaacaggttgaaccaacaatgattggttgatagactaaggatatatgcaactcttccagacttttccataaagctctctcggcagtcgctcacactacaatgcacacaaggattgagaagagttaaaggctaaagaaaacatcttttctagcttcaacagagaggtttcaccagcacatttaccagaagaatctgggaatggattccactacagtgatattgactgcatctttaagaagtgaccattatactgtgtatatatatataaacacacacacatatatatatatatatatagtactctaatactgcaagaaggttttttaaacttcccactttattttttatacacattaatcagatatcattacttgctgcagttgcaactatgcacttgtataaagccataatgttggagtttatatcactcattcctgtgtacctgatggaagttgcatgttcatgtttaagcagttactgtaacaagaagtttaaagttaattatatcagtttcctaatgcttcatgataggcaactttacccattttgaatgccttaatttaatttttttcaaagtctcagccctgtctgtattaaaaaacaaaaaaagcgtttaccagctcttaggatgtaaactagctttgtggaagataaatcgtgcactatttttacacataaatagttatatcaatgtcagcctattttgattaacaaatgtttttaaagtattattggttatagaaacaataatggatggtgttggaactaatatatccttgatgtctgtctattattcattcaactctttttacagacctcagtattagtctgtgactacaaaatattttatttgctttaaatttgctggctaccctagatgtgtttttattcctggtaaagacatttgtgattacattttcacacttaagattcaaaatttttcccaaatataaagaaaactaagacagactgtagatgcattttaaatatttaaatatgatcctcagacatgcagctgtgtgtggcagtattttagtaccgggttaagaaaactggcaactgggaagaagtggcctcaaaggcacttaatttgatttttattttttaaatgctgtcaaagttacagtttacgcaggacattcttgccgtattctcatgatcccagataagtgtgtgttttatactgcaacaatatgcagcaatggtaagcgtaaagttttttttttgtttttgtttttttttatattatgaagtcttttaacagtctctctttatataaatacacagagtttggtatgatatttaaatacatcatctggccaggcatggtggcttacgcctgtaatcctagcactttgggaggccaagacgggcggatcacctgaggtgaggagttcaagaccagcctgcccaacatagtgaaactccgtctctaccaatatacaaaaattagccgggcatgatggtggtggcctgtaatcccagctacttgggaggctgagacaggagaatcgcttgaacccaggagacggtggttgcagtgagcgaagatcgagccactgcactccagcctgggcagctgaacaagactccgtctc

SEQ ID NO: 601 - protein, 1388 aa, Homo sapiens
MSRPPPTGKMPGAPETAPGDGAGASRQRKLEALIRDPRSPINVESLLDGLNSLVLDLDFPALRKNKNIDNFLNRYEKIVKKIRGLQMKAEDYDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFFKNDQWHWDNIRETAAPVVPELSSDIDSSNFDDIEDDKGDVETFPIPKAFVGNQLPFIGFTYYRENLLLSDSPSCRETDSIQSRKNEESQEIQKKLYTLEEHLSNEMQAKEELEQKCKSVNTRLEKTAKELEEEITLRKSVESALRQLEREKALLQHKNAEYQRKADHEADKKRNLENDVNSLKDQLEDLKKRNQNSQISTEKVNQLQRQLDETNALLRTESDTAARLRKTQAESSKQIQQLESNNRDLQDKNCLLETAKLKLEKEFINLQSALESERRDRTHGSEIINDLQGRICGLEEDLKNGKILLAKVELEKRQLQERFTDLEKEKSNMEIDMTYQLKVIQQSLEQEEAEHKATKARLADKNKIYESIEEAKSEAMKEMEKKLLEERTLKQKVENLLLEAEKRCSLLDCDLKQSQQKINELLKQKDVLNEDVRNLTLKIEQETQKRCLTQNDLKMQTQQVNTLKMSEKQLKQENNHLMEMKMNLEKQNAELRKERQDADGQMKELQDQLEAEQYFSTLYKTQVRELKEECEEKTKLGKELQQKKQELQDERDSLAAQLEITLTKADSEQLARSIAEEQYSDLEKEKIMKELEIKEMMARHKQELTEKDATIASLEETNRTLTSDVANLANEKEELNNKLKDVQEQLSRLKDEEISAAAIKAQFEKQLLTERTLKTQAVNKLAEIMNRKEPVKRGNDTDVRRKEKENRKLHMELKSEREKLTQQMIKYQKELNEMQAQIAEESQIRIELQMTLDSKDSDIEQLRSQLQALHIGLDSSSIGSGPGDAEADDGFPESRLEGWLSLPVRNNTKKFGWVKKYVIVSSKKILFYDSEQDKEQSNPYMVLDIDKLFHVRPVTQTDVYRADAKEIPRIFQILYANEGESKKEQEFPVEPVGEKSNYICHKGHEFIPTLYHFPTNCEACMKPLWHMFKPPPALECRRCHIKCHKDHMDKKEEIIAPCKVYYDISTAKNLLLLANSTEEQQKWVSRLVKKIPKKPPAPDPFARSSPRTSMKIQQNQSIRRPSRQLAPNKPS

SEQ ID NO: 602 - protein, 263 aa, Homo sapiens
YDVVKVIGRGAFGEVQLVRHKASQKVYAMKLLSKFEMIKRSDSAFFWEERDIMAFANSPWVVQLFYAFQDDRYLYMVMEYMPGGDLVNLMSNYDVPEKWAKFYTAEVVLALDAIHSMGLIHRDVKPDNMLLDKHGHLKLADFGTCMKMDETGMVHCDTAVGTPDYISPEVLKSQGGDGFYGRECDWWSVGVFLYEMLVGDTPFYADSLVGTYSKIMDHKNSLCFPEDAEISKHAKNLICAFLTDREVRLGRNGVEEIRQHPFF

SEQ ID NO: 603 - protein, 61 aa, Homo sapiens
DQWHWDNIRETAAPVVPELSSDIDSSNFDDIEDDKGDVETFPIPKAFVGNQLPFIGFTYYR

SEQ ID NO: 604 - protein, 85 aa, Homo sapiens
TRLEKTAKELEEEITLRKSVESALRQLEREKALLQHKNAEYQRKADHEADKKRNLENDVNSLKDQLEDLKKRNQNSQISTEKVNQ

SEQ ID NO: 605 - protein, 85 aa, Homo sapiens
SRLEGWLSLPVRNNTKKFGWVKKYVIVSSKKILFYDSEQDKEQSNPYMVLDIDKLFHVRPVTQTDVYRADAKEIPRIFQILYANE

SEQ ID NO: 606 - protein, 55 aa, Homo sapiens
HEFIPTLYHFPTNCEACMKPLWHMFKPPPALECRRCHIKCHKDHMDKKEEIIAPC

SEQ ID NO: 607 - DNA, 1239 bp, Homo sapiens
atgggcagcccctggaacggcagcgacggccccgagggggcgcgggagccgccgtggcccgcgctgccgccttgcgacgagcgccgctgctcgccctttcccctgggggcgctggtgccggtgaccgctgtgtgcctgtgcctgttcgtcgtcggggtgagcggcaacgtggtgaccgtgatgctgatcgggcgctaccgggacatgcggaccaccaccaacttgtacctgggcagcatggccgtgtccgacctactcatcctgctcgggctgccgttcgacctgtaccgcctctggcgctcgcggccctgggtgttcgggccgctgctctgccgcctgtccctctacgtgggcgagggctgcacctacgccacgctgctgcacatgaccgcgctcagcgtcgagcgctacctggccatctgccgcccgctccgcgcccgcgtcttggtcacccggcgccgcgtccgcgcgctcatcgctgtgctctgggccgtggcgctgctctctgccggtcccttcttgttcctggtgggcgtcgagcaggaccccggcatctccgtagtcccgggcctcaatggcaccgcgcggatcgcctcctcgcctctcgcctcgtcgccgcctctctggctctcgcgggcgccaccgccgtccccgccgtcggggcccgagaccgcggaggccgcggcgctgttcagccgcgaatgccggccgagccccgcgcagctgggcgcgctgcgtgtcatgctgtgggtcaccaccgcctacttcttcctgccctttctgtgcctcagcatcctctacgggctcatcgggcgggagctgtggagcagccggcggccgctgcgaggcccggccgcctcggggcgggagagaggccaccggcagaccgtccgcgtcctgctggtggtggttctggcatttataatttgctggttgcccttccacgttggcagaatcatttacataaacacggaagattcgcggatgatgtacttctctcagtactttaacatcgtcgctctgcaacttttctatctgagcgcatctatcaacccaatcctctacaacctcatttcaaagaagtacagagcggcggcctttaaactgctgctcgcaaggaagtccaggccgagaggcttccacagaagcagggacactgcgggggaagttgcaggggacactggaggagacacggtgggctacaccgagacaagcgctaacgtgaagacgatgggataa

SEQ ID NO: 608 - DNA, 3286 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctgaaaaaaaaaa

SEQ ID NO: 609 - DNA, 2923 bp, Homo sapiens
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggtgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaacccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagccaaaaaaaaaa

SEQ ID NO: 610 - DNA, 3028 bp, Homo sapiens
gtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 611 - DNA, 2984 bp, Homo sapiens
gaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagtctggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctaaaaaaaaaaaaaa

SEQ ID NO: 612 - DNA, 2129 bp, Homo sapiens
cagactgccataagatggcgtccgtggcggctgcacgagcagttcccgtgggcagtgggctcaggggcctgcaacggaccctacctcttgtagtgattctcggggccacgggcaccggcaaatccacgctggcgttgcagctaggccagcggctcggcggtgagatcgtcagcgctgactccatgcaggtctatgaaggcctagacatcatcaccaacaaggtttctgcccaagagcagagaatctgccggcaccacatgatcagctttgtggatcctcttgtgaccaattacacagtggtggacttcagaaatagagcaactgctctgattgaagatatatttgcccgagacaaaattcctattgttgtgggaggaaccaattattacattgaatctctgctctggaaagttcttgtcaataccaagccccaggagatgggcactgagaaagtgattgaccgaaaagtggagcttgaaaaggaggatggtcttgtacttcacaaacgcctaagccaggtggacccagaaatggctgccaagctgcatccacatgacaaacgcaaagtggccaggagcttgcaagtttttgaagaaacaggaatctctcatagtgaatttctccatcgtcaacatacggaagaaggtggtggtccccttggaggtcctctgaagttctctaacccttgcatcctttggcttcatgctgaccaggcagttctagatgagcgcttggataagagggtggatgacatgcttgctgctgggctcttggaggaactaagagattttcacagacgctataatcagaagaatgtttcggaaaatagccaggactatcaacatggtatcttccaatcaattggcttcaaggaatttcacgagtacctgatcactgagggaaaatgcacactggagactagtaaccagcttctaaagaaaggtattgaggctctgaaacaagtaactaagagatatgcccggaaacaaaaccgatgggttaaaaaccgttttttgagcagacctggtcccattgtcccccctgtctatggcttagaggtatctgatgtctcgaagtgggaagagtctgttcttgaacctgctcttgaaatcgtgcaaagtttcatccagggccacaagcctacagccactccaataaagatgccgtacaatgaagctgagaacaagagaagttatcacctgtgtgacctctgtgatcgaatcatcattggggatcgcgaatgggcagcgcacataaaatccaaatcccacttgaaccaactgaagaaaagaagaagattggactcagatgctgtcaacaccatagaaagtcagagtgtttccccagaccataacaaagaacctaaagagaagggatccccagggcagaatgatcaagagctgaaatgcagcgtttaagagacatgtccagtggcctttggaaaggtggtggggatccagttcaggagggaggggtatgtttgtctcccagtctgggcaaaggagtgctatgcggaattctctgcatagcagaaaagctcccaccattttcttttgatgtggttttaaagtctcacgttctctataatagaaacagcaggtcttgtcagctccttgtgtggctgatgtgtctggaaatgatgtagttcaggaaagcattttttttttctttgaaccttaaaggttctattattaaaagcagcacagattccacatttttatacatgaggatcttctttgtggtgaataccaggattgactgcatccctttaaagaagttttatgtccctgactctggctaaaattatctaatttccagatgcttttgtagatgactgaagtatttgtgagccacatattgggagttctagatttgagtgaatggcaggaaagggccatctccattgagatgattaagtgaaccaaactagttctcggaattctacagagaaggagggaatcagactgaagaagctgtgacataggacttgaagaccaaagactttgaaatttgcgagctgctcatgtgtgagttattatcactgctgtctttctattgagttacaaatctatatttttattgaagtttaaataaagaaaaaatttaaaaaaaaaaaaaaaaaaaaaaaa

SEQ ID NO: 613 - DNA, 5907 bp, Homo sapiens
aaagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctctggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttctttgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatataaatataaatatatgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcgcactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagcagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagtttgacctggttgtgttattttaccagaccttggtaaaagaactattttggaaacagtatttgtaaatggaactaatgctatatttaaaaacactgatttttttttaacctgccaaaaataaaaaaaagctcattttataattttctactaaaaaaa

SEQ ID NO: 614 - DNA, 5791 bp, Homo sapiens
aagttcatccccccagaatgaaaatgaggacatttgagaaggtgatttaaggtgtggacatttgagaaggtgtcctatcaaattagtaaaccaaaggaaaagtactgaatagattaatccaaaacacttactgttttttaaacgaagaggatttcaccttgacagaaaaacaacttttattcaatatgtatttcctgaaattaaagagacaagtacagactgaaaggaaaatagattcgtaaataagctacgtcaactctatcctgctgaggatagctcagtgatgttaaatcctttacaaatccctggttgtcttcctacagacaagactgctttttgatgggactgatattaagagaaataggacctttggggcattcaactccttgataaaacttaaaagtatcggcatgagtggcttaacagaggaaataaagaagttttcaactaaatccaaaagtgcggtcattttctttactgctgttattttaaaaacctcttcataaccattgaaaaagaatcgacaactattttaaaagattaaagaaaggcagatgtctgcaaataattcccctccatcagcccagaagtctgtattacccacagctattcctgctgtgcttccagctgcttctccgtgttcaagtcctaagacgggactctctgcccgactctctaatggaagcttcagtgcaccatcactcaccaactccagaggctcagtgcatacagtttcatttctactgcaaattggcctcacacgggagagtgttaccattgaagcccaggaactgtctttatctgctgtcaaggatcttgtgtgctccatagtttatcaaaagtttccagagtgtggattctttggcatgtatgacaaaattcttctctttcgccatgacatgaactcagaaaacattttgcagctgattacctcagcagatgaaatacatgaaggagacctagtggaagtggttctttcagctttagccacagtagaagacttccagattcgtccacatactctctatgtacattcttacaaagctcctactttctgtgattactgtggtgagatgctgtggggattggtacgtcaaggactgaaatgtgaaggctgtggattaaattaccataaacgatgtgccttcaagattccaaataactgtagtggagtaagaaagagacgtctgtcaaatgtatctttaccaggacccggcctctcagttccaagacccctacagcctgaatatgtagcccttcccagtgaagagtcacatgtccaccaggaaccaagtaagagaattccttcttggagtggtcgcccaatctggatggaaaagatggtaatgtgcagagtgaaagttccacacacatttgctgttcactcttacacccgtcccacgatatgtcagtactgcaagcggttactgaaaggcctctttcgccaaggaatgcagtgtaaagattgcaaattcaactgccataaacgctgtgcatcaaaagtaccaagagactgccttggagaggttactttcaatggagaaccttccagtctgggaacagatacagatataccaatggatattgacaataatgacataaatagtgatagtagtcggggtttggatgacacagaagagccatcacccccagaagataagatgttcttcttggatccatctgatctcgatgtggaaagagatgaagaagccgttaaaacaatcagtccatcaacaagcaataatattccgctaatgagggttgtacaatccatcaagcacacaaagaggaagagcagcacaatggtgaaggaagggtggatggtccattacaccagcagggataacctgagaaagaggcattattggagacttgacagcaaatgtctaacattatttcagaatgaatctggatcaaagtattataaggaaattccactttcagaaattctccgcatatcttcaccacgagatttcacaaacatttcacaaggcagcaatccacactgttttgaaatcattactgatactatggtatacttcgttggtgagaacaatggggacagctctcataatcctgttcttgctgccactggagttggacttgatgtagcacagagctgggaaaaagcaattcgccaagccctcatgcctgttactcctcaagcaagtgtttgcacttctccagggcaagggaaagatcacaaagatttgtctacaagtatctctgtatctaattgtcagattcaggagaatgtggatatcagtactgtttaccagatctttgcagatgaggtgcttggttcaggccagtttggcatcgtttatggaggaaaacatagaaagactgggagggatgtggctattaaagtaattgataagatgagattccccacaaaacaagaaagtcaactccgtaatgaagtggctattttacagaatttgcaccatcctgggattgtaaacctggaatgtatgtttgaaaccccagaacgagtctttgtagtaatggaaaagctgcatggagatatgttggaaatgattctatccagtgagaaaagtcggcttccagaacgaattactaaattcatggtcacacagatacttgttgctttgaggaatctgcattttaagaatattgtgcactgtgatttaaagccagaaaatgtgctgcttgcatcagcagagccatttcctcaggtgaagctgtgtgactttggatttgcacgcatcattggtgaaaagtcattcaggagatctgtggtaggaactccagcatacttagcccctgaagttctccggagcaaaggttacaaccgttccctagatatgtggtcagtgggagttatcatctatgtgagcctcagtggcacatttccttttaatgaggatgaagatataaatgaccaaatccaaaatgctgcatttatgtacccaccaaatccatggagagaaatttctggtgaagcaattgatctgataaacaatctgcttcaagtgaagatgagaaaacgttacagtgttgacaaatctcttagtcatccctggctacaggactatcagacttggcttgaccttagagaatttgaaactcgcattggagaacgttacattacacatgaaagtgatgatgctcgctgggaaatacatgcatacacacataaccttgtatacccaaagcacttcattatggctcctaatccagatgatatggaagaagatccttaatcactgagctaacctaaataaggaaggatttcattttatggactgatattttgctgtgtaacttgttcttcgtagattgtcatctgcagtgctgcaaagatatgaagaaatatgataacgaataagtgacaccagtactgtagttcataatgagtaggtacaggcgggaaactgaataataagaagtcataatggaatcaaggtgaagctttttataaacttttttagcctaagcaataactggttttgtattttttcttaatccttcactttaatacaataggctcacttaatttgtcttcccatttctctttatatatatatatatatataaaaaaatataaatatatgtttgtttgtttgtttttttaaggaaaaacaagtcaagctagcatccagttactatatagcttggctaaattatacaagacttacaagattgattactcgacaggcttgtatttaagagataactgtgaggttaccattatgtgatgttactataaggacttttaacattggtttaacaaaccatagaggcattgaagggtttttcttagatgcctagaaaaagcacactgggctgttttacctttcttttttaggtcaatcaagactccaaaatagtgattcctaacctttttggagttgctctgctactctgaatatgttctatacagcataaggattgtcaccttctgtgtgttgcaacagcttctaagataattagggacaaatgatgttacaaaaggaagagtactgctggtctaagtgctgagttgtatgtctttgcatagctccactctgctgctaaatatgcatgttctgactgacaccatcttgatgccagtactggattccagcattcagcaggtgcagatctcggctttacacaatttatctttacctagggttcagtcagtaatttctgctttttagccagggccagtgcagggtcagttaatgctacagttactgtatagcaaacagtatccttttttctccttcccctagcctattgggctttgcagatatctggagtgttttaaagtcaattattttaagcagtttgaggggatgtgtaggagtggagcatgaaacagtttataaggctggggctgtattatcagcacagcaaattaaagaatgaaagaagtacttctttttacatttcagctccagcagccagctatttaaaaaatatttttaaatatcttccccaaagtttaagatgtgggaccatctacttgtaagaaacagtggcttatttcttcatttctcagtaatcattgtaaacctttttttttttcttctccactctaacaaaagtaaaagaacaaaacttttgctgaggtcttggactccactacttgttagttatgttggcctggacagatggcaggtctgtcggcagttcctcagtctgtaaaatgaagattatcattcttgcctctccctttgtcacagtgttgtcgtgaagatcagatatgtatgaatgcagtcaaataaactaaaaactaggaaagtgttaactatcgttgcccaccgaatttgaggtagcaaaaaaaaaaaagaatgttctggtacatgaacagactgagaaggcctttcgacatccctgaagctagtctcctgtctagactaaaaatatccttgaaagaatagtagcaaacagtatgcagtactcctgtgttctaagttcttttatgttttagtttaccctcacagcagccatagtgttaagtcattatgagcttcatcttaaagataagaaaactgaggcaaggggagattaacttactgccaaatttcaaacagttagtagtatttgagaccagtagtatggctctaatcttacccttagccctcccaaccattatgctgtactatctacccataaatacctccaggaaacattcccctcttggtaatttgtccttctatagaagcttcaaagattaaatcaaattaattttcaaaaaaaatttttttttagaaatgttattttccctgtgatagaggatgacttcccagtttcaccaaagtctgtttatatcaacacacacaaaatggaataattctgagtcactaggcaatcaatctactgtggttttactatgtaaggtgaaaattaactggaacgatgtttgtttgctatacttacatagtcaaactttacaagccatgaaattaattgcactctttgtatttgttgttaaatgcctaagaagttttctaaaaattttgtaaaggcactgtcagagaatctggagttgaatgattattccagatactgtataacctgcataactttttgtctttaagtcgtgtttgtaaaagaagtaattgctagaaacatttgataatgtacaaagtagtctataatgactgttcagtacatttttaatatttttttggttatatccaactttttgtaaatatactggaagcttgataataaaatgtatttcctatcaccatacttttccatgtgaaaacctgagcctatttctagtataagtatccaaagaaaagttttacctggttgtgttattttaccagac

SEQ ID NO: 615 - DNA, 2201 bp, Homo sapiens
caactacgagccacgagtttgcagatggggctgctcggcggcgcctgtggctgagggagagcagcggcggcggggagcgaccgggagcggcggcagcggcggcgcggaggcggctgaggtgcgagccggactaaatcattttgctactttaaaaaaatcacgaaagtacattatttgaagtttggagaagaaagggatttggtaacaaaggacagccatttccattttaagcagctaaacagcaggagagatttctgtaagaaggtaccagctcagattccattgttcatcattttgcaatgcagcaagtcttggaaaaccttacggagctgccctcgtctactggagcagaagaaatagacctaattttcctcaagggaattatggagaatcctattgtaaaatcacttgctaaggctcatgagaggctagaagattccaaactagaagctgtcagtgacaataacttggaattagtcaatgaaattcttgaagacatcactcctctaataaatgtggatgaaaatgtggcagaattggttggtatactcaaagaacctcacttccagtcactgttggaggcccatgatattgtggcatcaaagtgttatgattcacctccatcaagcccagaaatgaataattcttctatcaataatcagttattaccagtagatgccattcgtattcttggtattcacaaaagagctggggaaccactgggtgtgacatttagggttgaaaataatgatctggtaattgcccgaatcctccatgggggaatgatagatcgacaaggtctacttcatgtgggagatataattaaagaagtcaatggccatgaggttggaaataatccaaaggaattacaagaattactgaaaaatattagtggaagtgtcaccctaaaaatcttaccaagttatagagataccattactcctcaacaggtatttgtgaagtgtcattttgattataatccatacaatgacaacctaataccttgcaaagaagcaggattgaagttttccaaaggagaaattcttcagattgtaaatagagaagatccaaattggtggcaggctagccatgtaaaagagggaggaagcgctggtctcattccaagccagttcctggaagagaagagaaaggcatttgttagaagagactgggacaattcaggacctttttgtggaactataagtagcaaaaaaaagaaaaagatgatgtatctcacaaccagaaatgcagaatttgatcgtcatgaaatccagatatatgaggaggtagccaaaatgcctcccttccagagaaaaacattagtattgataggagctcaaggtgtaggccgaagaagcttgaaaaacaggttcatagtattgaatcccactagatttggaactacggtgccatttacttcacggaaaccaagggaagatgaaaaagatggccaggcatataagtttgtgtcacgatctgagatggaagcagatattaaagctggaaagtatttggaacatggggaatatgaaggaaatctctatggaaccaaaattgattctattcttgaggttgtccaaactggacggacttgcattctggatgtcaacccacaagcactgaaagtattgaggacatcagagtttatgccctatgtggtatttattgcggctccggagctagagacgttacgtgccatgcacaaggctgtggtggatgcaggaatcactaccaagcttctgaccgactctgacttgaagaaaacagtggatgaaagtgcacggattcagagagcatacaaccactattttgatttgatcatcataaatgataatctagacaaagcctttgaaaaactgcaaactgccatagagaaactgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacataaagaaatgcgttgaagcaaaaaaaaaaaaaaa

SEQ ID NO: 616 - DNA, 1953 bp, Homo sapiens
gcagaccttgcttcatgagcaagctcatctctggaacaaactggcaaagcatctctgctggtgttcatcagaacagacaccatggcagagcatgattaccatgaagactatgggttcagcagtttcaatgacagcagccaggaggagcatcaagacttcctgcagttcagcaaggtctttctgccctgcatgtacctggtggtgtttgtctgtggtctggtggggaactctctggtgctggtcatatccatcttctaccataagttgcagagcctgacggatgtgttcctggtgaacctacccctggctgacctggtgtttgtctgcactctgcccttctgggcctatgcaggcatccatgaatgggtgtttggccaggtcatgtgcaagagcctactgggcatctacactattaacttctacacgtccatgctcatcctcacctgcatcactgtggatcgtttcattgtagtggttaaggccaccaaggcctacaaccagcaagccaagaggatgacctggggcaaggtcaccagcttgctcatctgggtgatatccctgctggtttccttgccccaaattatctatggcaatgtctttaatctcgacaagctcatatgtggttaccatgacgaggcaatttccactgtggttcttgccacccagatgacactggggttcttcttgccactgctcaccatgattgtctgctattcagtcataatcaaaacactgcttcatgctggaggcttccagaagcacagatctctaaagatcatcttcctggtgatggctgtgttcctgctgacccagatgcccttcaacctcatgaagttcatccgcagcacacactgggaatactatgccatgaccagctttcactacaccatcatggtgacagaggccatcgcatacctgagggcctgccttaaccctgtgctctatgcctttgtcagcctgaagtttcgaaagaacttctggaaacttgtgaaggacattggttgcctcccttaccttggggtctcacatcaatggaaatcttctgaggacaattccaagactttttctgcctcccacaatgtggaggccaccagcatgttccagttataggccttgccagggtttcgagaagctgctctggaatttgcaagtcatggctgtgccctcttgatgtggtgaggcaggctttgtttatagcttgcgcattctcatggagaagttatcagacactctggctggtttggaatgcttcttctcaggcatgaacatgtactgttctcttcttgaacactcatgctgaaagcccaagtagggggtctaaaatttttaaggactttccttcctccatctccaagaatgctgaaaccaagggggatgacatgtgactcctatgatctcaggttctccttgattgggactggggctgaaggttgaagaggtgagcacggccaacaaagctgttgatggtaggtggcacactgggtgcccaagctcagaaggctcttctgactactgggcaaagagtgtagatcagagcagcagtgaaaacaagtgctggcaccaccaggcacctcacagaaatgagatcaggctctgcctcaccttggggcttgacttttgtataggtagatgttcagattgctttgattaatccagaataactagcaccagggactatgaatgggcaaaactgaattataagaggctgataattccagtggtccatggaatgcttgaaaaatgtgcaaaacagcgtttaagactgtaatgaatctaagcagcatttctgaagtggactctttggtggctttgcattttaaaaatgaaattttccaatgtctgccacacaaacgtatgtaaatgtatatacccacacacatacacacatatgtcatatattactagcatatgagtttcatagctaagaaataaaactgttaaagtctccaaact

SEQ ID NO: 617 - DNA, 2632 bp, Homo sapiens
gggcccggcgcgcggtagcgcgggcccctcagtgcacaatggctagagcaggcggcggagccccaaccccacccagtgcggagcgcgccgcgagccccgccgcaagctgagcgcctccgcccgccaggcgcgccggcgccgggccatgtactcggggaaccgcagcggcggccacggctactgggacggcggcggggccgcgggcgctgaggggccggcgccggcggggacactgagccccgcgcccctcttcagccccggcacctacgagcgcctggcgctgctgctgggctccattgggctgctgggcgtcggcaacaacctgctggtgctcgtcctctactacaagttccagcggctccgcactcccactcacctcctcctggtcaacatcagcctcagcgacctgctggtgtccctcttcggggtcacctttaccttcgtgtcctgcctgaggaacggctgggtgtgggacaccgtgggctgcgtgtgggacgggtttagcggcagcctcttcgggattgtttccattgccaccctaaccgtgctggcctatgaacgttacattcgcgtggtccatgccagagtgatcaatttttcctgggcctggagggccattacctacatctggctctactcactggcgtgggcaggagcacctctcctgggatggaacaggtacatcctggacgtacacggactaggctgcactgtggactggaaatccaaggatgccaacgattcctcctttgtgcttttcttatttcttggctgcctggtggtgcccctgggtgtcatagcccattgctatggccatattctatattccattcgaatgcttcgttgtgtggaagatcttcagacaattcaagtgatcaagattttaaaatatgaaaagaaactggccaaaatgtgctttttaatgatattcaccttcctggtctgttggatgccttatatcgtgatctgcttcttggtggttaatggtcatggtcacctggtcactccaacaatatctattgtttcgtacctctttgctaaatcgaacactgtatacaatccagtgatttatgtcttcatgatcagaaagtttcgaagatcccttttgcagcttctgtgcctccgactgctgaggtgccagaggcctgctaaagacctaccagcagctggaagtgaaatgcagatcagacccattgtgatgtcacagaaagatggggacaggccaaagaaaaaagtgactttcaactcttcttccatcatttttatcatcaccagtgatgaatcactgtcagttgacgacagcgacaaaaccaatgggtccaaagttgatgtaatccaagttcgtcctttgtaggaatgaagaatggcaacgaaagatggggccttaaattggatgccacttttggactttcatcataagaagtgtctggaatacccgttctatgtaatatcaacagaaccttgtggtccagcaggaaatccgaattgcccatatgctcttgggcctcaggaagaggttgaacaaaaacaaattcttttaattcaacgggtgctttacataatgaaaaaaccacttgtggcacacgatgggcatctaacatcatcatcttctaatgtgttggagattttcatttcaaatatattttttaaattactctattttccaaaacacgtaatgcatttttctcgaaaataccttactgtaaaaataactgtcgcgtacacatgtgtgaagtagctagaacatactgaattttttttgtactgttggactctattcagtgtcatgtcctatatctgatcaagttatcaaggagataattctagaatgaaaaagaaaatcctcttgttggaaacaaaagacgttttatatgtgcagtatgacaaagaggagtttcagagacaactttgaatccttgtcagcctggagaccagcaccagaggaatctacaaggcaaactcccatatatttgcttcccccaaattgctgcccctacagactcaaagctctttttctttgttttgttgtttctctaaaaatttactgttctttgtcgatgctatataagccagggagttctaagacgccagctctttgagatttgctcattcccctgtatttcccacatatatattacatatacccgctaataaatttatgtttgtttttctcttgtcaatctgtcttttgttataggggccccagccaaggaacctaaagtgggtagaaggaaaaattattttttctttccctacaaactgaacatggattattagaactcaaggttttcattgacaatatagaaaagaaacactgaatcattttattttattgcccaatttttatttcttatatgactctagtgtttcatcttcataattaatcatgtttgaaggatttctgagtgactcagcagcctgttaaagaaggatgaaccaaagaaaacatttcactaaatgtgcttttaaaaatcaagtgtattgctggttctgctgcagtatgtagtcgaagaataaattagtaaattgcttctgagggtctgaaattgaataaagtaatggctttgtatttctataaaagttgtctccccttgtttcctttccattctggcacatgtagacatttaattta

SEQ ID NO: 618 - DNA, 2345 bp, Homo sapiens
ctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccagcgtctgcattgctccggactcagccaagttccccaacggctccccgtcgtcctggtgctgcagcgtgtgccggtccaacaaaagcccttgggtctgtttgacttgttcaagtgtccactgtggaaggtatgtgaatggccatgcaaaaaaacattatgaagatgcacaagtacctttaaccaaccataagaaatcagaaaagcaagataaagttcagcacacagtatgtatggattgcagtagctacagtacatactgttatcgctgtgatgattttgtggttaatgacaccaagctgggactggtacagaaagtcagagaacacttacagaacttggaaaactcagctttcacagctgacaggcataagaaaagaaaacttttggaaaactcaacactaaacagcaagttattaaaagtaaatggaagcaccactgccatttgtgccacaggccttcggaatttggggaacacatgtttcatgaatgccatccttcagtcactcagtaacattgagcagttttgctgttatttcaaagaactgcccgccgtggagttaaggaatgggaaaacagcaggaaggcggacataccacaccaggagccaaggggataacaatgtgtctttggtagaagagtttagaaagacactctgtgctttatggcaaggcagccagactgcatttagcccagagtccttattttatgttgtttggaagattatgccaaactttaggggctatcaacagcaggacgcccatgaattcatgcgctaccttttggaccacctacacttggaacttcagggcggtttcaacggtgtttcccgctcagcaattctgcaggagaattctactctgtctgcaagtaacaagtgttgcataaatggagcatctactgttgtcacggctatattcggaggcattctccaaaatgaggttaactgcctcatatgtgggacagaatctagaaagtttgatccattcctagacctttcattagatattccaagtcagttcagaagtaagcgctctaagaatcaagaaaatggaccagtttgttcgttacgagattgtcttcgcagttttaccgacttagaagaacttgatgagacagagttatatatgtgccataaatgcaaaaagaaacaaaagtccacaaaaaagttttggattcaaaaactacccaaggtgctatgcttacatttgaaaagatttcattggacagcatatttaagaaataaagttgatacatacgtagaatttccactgagaggcctagacatgaaatgctacttactagagcctgagaacagtggcccggagagctgcctgtatgacctcgccgctgtggtggtgcaccatggttccggggttggttctggacattacacagcatacgcaactcacgaaggccgctggttccacttcaatgacagtactgtaacactgactgacgaggagactgtggtgaaggcgaaggcctacatccttttctacgtggaacaccaggccaaagctggatcggataaactttaatacctcctccaaatcatcattcaccaaccataccagagaaacatttccagttttccacaaatacttgatacaagatttaatttcattatgcacttttcaatttcctattttggatttagttttgtcaatggtagtgacttactgaacatgggcaccaactaattttgttgttgttctaccagaaaacctcagcagatgttttgatttgctgctttagttgtaataattcaatttttataggtagttgtaagaacttagtcttatttgacttttttattttatgttaatgttttcagttctcactttgaggcacatttacatcaatgcttttgttcctctcacatgctgaaagcaagatgtgttccttattgtgaagagcgacacaactgcctgctgcctttccacagctataatggacatcaggttgactctaaatcaaggatcatgtgtgcacaatacttgtggcccacaaaatttcacaatgactgctgaggaatcattctttttgcctgtaaaatataacaaagggcatcattaagtagaccaggtaattactgcttgtctctcaaggctgctgtctttatcagcactaactaaataaatttgttggttcagttgtacttgtcctgcaaatacaaaaaaaaaaaaaaaaa

SEQ ID NO: 619 - DNA, 3923 bp, Homo sapiens
aaagagcccgctccgccgagcgccgggcgacggcaggaagcccctccgcttggccagaatggagcagccgaagggagttgattggacagtcatcatcctgacctgccagtacaaggacagtgtccaggtctttcagagagaactggaagtgcggcagaagcgggagcagatccctgctgggacgctgttactggccgtggaggacccagagaagcgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccctgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccaggggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgcaaaaaaaaaaaaaaaaa

SEQ ID NO: 620 - DNA, 2584 bp, Homo sapiens
atagggaggtcgggtagaggctcccgggacctgcgtgctgccgagagaggaagcgaagggcaccatctttgtattttgtgtcatgacttctcaagagaagacagaagagtatccttttgcagatatatttgatgaagatgaaactgaaaggaattttttgttgtccaaacctgtttgctttgttgtatttgggaaaccaggtgttgggaaaacaacattagcccgttacataacacaggcatggaaatgtattcgtgttgaagctttgccaattttagaagaacagattgctgctgaaaccgaatcaggagttatgttgcaatcaatgttgatcagcggtcaaagcattccagatgaacttgtcataaagctaatgttggagaagctcaactccccagaagtctgtcactttggttatattatcactgaaataccatcactttcacaggatgccatgactaccttacagcaaatagaattaattaaaaacttaaacctgaaacctgatgttataatcaatataaagtgtcctgactatgatttgtgccagagaatttctgggcaaagacagcacaataatacgggatacatatacagtagagaccagtgggatcctgaagtcattgagaatcataggaaaaagaagaaagaagcccaaaaggacggaaaaggagaagaggaagaagaggaagaagagcaagaagaagaagaggcatttattgccgaaatgcagatggtggctgaaattcttcatcatctagtccagaggcctgaagattatttggaaaatgttgaaaacattgttaagctttataaggaaacaattctccaaactttagaagaagtaatggctgaacacaatccccagtatctcattgagctaaatggaaataaaccagcagaggagctctttatgattgttatggatcgacttaaatatctgaacctaaaaagagcagctattctaaccaaacttcagggtgcagaggaagaaattaatgacacaatggaaaatgatgagctatttcgtactcttgcatcttataaacttattgcaccaagatacagatggcaaagaagtaaatggggacgtacatgtcctgtgaatttaaaagatggtaacatttattcaggattaccagattattctgtgagttttctaggtaaaatctactgtctttcatcagaagaagcattaaaaccatttttgttgaacccacgtccctatctgcttccacctatgccaggaccaccatgtaaagtattcatacttggacctcaatattcagggaaaacaacactttgcaatatgcttgcagaaaattacaaaggaaaggtgactaactaactatctgtctatctatctatctatctatctatctatctatctatctatctatgtctatctgtcatgtatctatactcgattataatttgtaggattttatttgtactcagtttttaaaatttcatgttttaattgaataattgttccactgggcttggggtagggtaggcattctttttgttgtttattgctgcttccagaccagagtccctccctgcttcccaaaagctcccacatgtgaatatcgtgtcattcagactctgccacctattagctttcttggttctactcatcttctgtcccctgggtttcacttctcctggctcactctcactctccccatataatcactcctgtcctaattcttggtgatttcagtattacaaagatgatcctcccaacaccttgacacctccctcagtaatcttgttctccactctcagtaaatgaaattatttttagcttagacaagagtgatagcagtaaaagtggtatgaaacaagcatatttgggatataatttgaagacaaagctgaaagatttgatgagggattggaatgtggaggaattctagaaggggcaatgtggcttgaggattgcctatgcaagaaggaatggcacaagatcatggctaaagacagagcaattcaggccacagaaaggtgttagaagttgttcaaagtgctgttgcattcttttaagcgccggagtatcattttctatttgcttttaactttttcattgtgaaacatgacaaacatacagaaaagtgaagcccactgagttaccgcaaaatgaacccccatgtaaccaccaaccaggtcaaatctggaatgttgccagcacccagacgccctctcatgtttcttctcaataccagtctcctcactctccacacaaaggtaaccactgcccagaattttatggcattcacttccatacttctcctatggttttgccgtggaagcatacatccaaataccataggctagttttgcatggtttttttgaattttatagacctaaacaatttatcttctttgtgcctggcttctttcacttaacattataattatgatatttgtccagactattgaatgtagctgtagtttattcatttttattgttttattgtattctgttgattgacttataccataatgtatttatccacatttgagcactaataaaacttggattgattccagattggagtaaacaaaaaaaaaaaaaaaa

SEQ ID NO: 621 - DNA, 3833 bp, Homo sapiens
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacctcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagagttcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttcagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatacttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcaccattttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctgagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattat

SEQ ID NO: 622 - DNA, 784 bp, Homo sapiens
gagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcaaaaaaaaaaaaaaaaaaaaaaaaaaaaaaa

SEQ ID NO: 623 - DNA, 2351 bp, Homo sapiens
tgcgggcaggattcacgccgctgtgacccggaggtcctcagggggcgaagccccggcctaggcctcgcggagatgcccagctgcggtgcttgtacttgcggcgcggcggccgtccggctcatcacctcctcactcgcctccgcgcagagaggtatttctggtggtcgcattcatatgtcagttttaggaaggcttgggacatttgaaactcagattctgcaaagagctcctcttagatcctttacagaaacaccagcatactttgcctcaaaagatgggataagtaaagatggttctggagatggaaataagaaatcagcaagtgagggaagtagtaagaaatcaggctctgggaattctgggaaaggtggaaaccagctgcgctgtcctaaatgtggcgacttgtgcacacatgtagagacctttgtatcatccacccgttttgtcaagtgtgaaaagtgtcatcatttttttgttgtgctatctgaagcagactcaaagaaaagcataattaaagaacctgaatcagcagcagaagctgtaaaattggcattccaacagaaaccaccacctccccctaagaagatttataactacctcgacaagtatgttgttggccagtcatttgctaagaaggtgctttcagttgctgtgtacaatcattataagagaatatataataatatcccagctaatctgagacagcaagcagaggttgagaagcagacatcattaacaccaagagagttagaaataagaagacgggaggatgagtacagatttacaaaattgcttcagattgctggaattagcccacatggtaatgctttaggagcatcaatgcagcaacaggtaaatcaacaaatacctcaggaaaaacgaggaggtgaagtattggattcttctcatgatgacataaaacttgaaaaaagtaatattttgctgcttggaccaactgggtcaggtaaaactctgctggcacaaaccctagctaaatgccttgatgtcccttttgctatctgtgactgtacaactttgactcaggctggatatgtaggcgaagatattgaatctgtgattgcaaaactactccaagatgccaattataatgtggaaaaagcacaacaaggaattgtctttctggatgaagtagataagattggcagtgtgccaggcattcatcaattacgggatgtaggtggagaaggcgttcagcaaggcttattaaaactactagaaggcacaatagtcaatgttccagaaaagaattcccgaaagctccgtggagaaacagttcaagttgatacaacaaacatcctgtttgtggcatctggtgctttcaatggtttagacagaatcatcagcaggaggaaaaatgaaaagtatcttggatttggaacaccatctaatctgggaaaaggcagaagggctgcagctgctgcagaccttgctaatcgaagtggggaatcgaatactcaccaagacattgaagaaaaagatcggttattgcgtcatgtggaagccagagatctgattgagtttggcatgattcctgagtttgtgggacggttgcctgtggtggttccattgcatagcctagatgagaaaacacttgtacaaatattaactgagccacgaaatgctgttattcctcagtaccaggccttattcagcatggataagtgtgaactgaatgttactgaggatgctttgaaagctatagccagattggcactagaacgaaaaacaggtgcacgaggccttcggtccataatggaaaagctgttactagaaccaatgtttgaagtccctaattctgatatcgtatgtgtggaggttgacaaagaagtagtagaaggaaaaaaggaaccaggatacatccgggctccaacaaaagaatcctctgaagaggagtatgactctggagttgaagaagaaggatggccccgccaagcagatgctgcaaacagctaaactgtcatattgctgtcttgtatatacagcttttccttcttttgtttaggatcataattgtctctacagtctgatattaaaggcattggatctatcttggatatcatacatggtcagagaagcctttaggagaagaatcagatcatgtatataattgtaacatcacattgattttacggaagatgttatatggactttaatgacacaatgtttagagataaaatgtacattattttggttcagttttttaaaaaaaatatgctttaacaaaattcttaggaattcttttaagcaatgcaggtattgcgataactgtagattttacaataatgttactctacaaatgggaaaataaattctttaaaattgaatattga

SEQ ID NO: 624 - DNA, 4684 bp, Homo sapiens
cttcggtctcttctccccggctgatcccagcactctccgtgacagcgcctcctgactcagcccaggaccggcttcttctcacgacctgctggagactggacgcccacacctgacccggaactcggaggcgtgcttcctccacccgccggctagcagccccgggccctgagctcccgccgacgccgctggggggcccgacaggcccctcggcgctgatgctgagtgggatcgagggcccggggcggcggcggagtacgggcctctggcgccttaggccagccgcaggtgtcggttcttaggctctccaggctcgctagctcccgccccggcttggatgggtctccctgcgccataaatgtggctgctgaggcggcggtggccgtggcccgtcgcgctgctgctgcggcgctccaagttcatctccgccccggggctctcctgccccacctcggggctgccgccacccgctccttatcccctggccctggccttgcagcgtggcgacaatggacaagatcctggagggccttgtgagttcctcgcatcccctgcccctcaagcgggtgattgtgcggaaggtggtggaatcggcggagcactggctagacgaggcgcagtgcgaggccatgtttgacctgacgacccggctcatcctggagggccaggaccctttccagcggcaggtggggcaccaggtgctggaggcctacgcacgataccaccggccagagttcgagtccttcttcaacaagaccttcgtgttgggcctccttcatcagggctaccactctctggacaggaaggatgtagccatcctggactacattcacaacggcctgaagctgattatgagctgtccgtcggtgctggatctctttagcctcctgcaggtagaggtgttacggatggtgtgtgagaggccggagccgcagctctgtgcccgactgagcgaccttctgaccgactttgtgcaatgcatccccaaggggaaattgtccatcacgttctgtcaacagctggttcgaacgataggccatttccagtgcgtgtccacccaggaaagagagctgcgggaatatgtctcccaggtgacaaaagtgagtaacttgctgcagaacatctggaaggccgagcctgccacactactgccttccctgcaagaagtttttgcaagcatctcttccacagatgcatcatttgaaccttctgtagcattggcaagccttgtgcagcatattcctcttcagatgattacagttctcatcaggagccttactacggatccaaatgtaaaagatgcaagtatgacccaagccctttgcagaatgattgactggctatcctggccattggctcagcatgtggatacatgggtaattgcactcctgaaaggactggcagctgtccagaagtttactattttgatagatgttactttgctgaaaatagaactggtttttaatcgactttggtttcctcttgtgagacctggtgctcttgcagttctttctcacatgctgcttagctttcagcattctccagaggcgttccatttgattgttcctcatgtggttaatttggttcattctttcaaaaatgatggtctgccttcaagtacagccttcttagtacaattaacagaattgatacactgtatgatgtatcattattctggatttccagatctctatgaacctattctggaggcaataaaggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagatttcaggagacaagtattatctttaaatctaaatgggtgcaattcattaatgaaaaaattacagcatctttttgcctttctggcccatacacagagggaagcatacgcacctcggatattctttgaggcttccagacctccatggtttactcccagatcacagcaagactgttctgaatacctcagatttctccttgacaggctccatgaagaagaaaagatcttgaaagttcaggcctcacacaagccttctgaaattctggaatgcagtgaaacttctttacaggaagtagctagtaaagcagcagtactaacagagacccctcgtacaagtgacggtgagaagactttaatagaaaaaatgtttggaggaaaactacgaactcacatacgttgtttgaactgcaggagtacctcacaaaaagtggaagcctttacagatctttcgcttgccttttgtccttcctcttctttggaaaacatgtctgtccaagatccagcatcatcacccagtatacaagatggtggtctaatgcaagcctctgtacccggtccttcagaagaaccagtagtttataatccaacaacagctgccttcatctgtgactcacttgtgaatgaaaaaaccataggcagtcctcctaatgagttttactgttctgaaaacacttctgtccctaacgaatctaacaagattcttgttaataaagatgtacctcagaaaccaggaggtgaaaccacaccttcagtaactgacttactaaattattttttggctccagagattcttactggtgataaccaatattattgtgaaaactgtgcctctctgcaaaatgctgagaaaactatgcaaatcacggaggaacctgaataccttattcttactctcctgagattttcatatgatcagaagtatcatgtgagaaggaaaattttagacaatgtatcactgccactggttttggagttgccagttaaaagaattacttctttctcttcattgtcagaaagttggtctgtagatgttgacttcactgatcttagtgagaaccttgctaaaaaattaaagccttcagggactgatgaagcttcctgcacaaaattggtgccctatctattaagttccgttgtggttcactctggtatatcctctgaaagtgggcattactattcttatgccagaaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacagcttatgtgcttttgtataaaaaacagcatagtactaatggtttaagtggtaataacccaaccagtggactctggataaatggagacccacctctacagaaagaacttatggatgctataacaaaagacaataaactatatttacaggaacaagagttgaatgctcgagcccgggccctccaagctgcatctgcttcatgttcatttcggcccaatggatttgatgacaacgacccaccaggaagctgtggaccaactggtggagggggtggaggaggatttaatacagttggcagactcgtattttgatcctgagagagtccaaaatgcactggtcacgaaacgtctaatactatgactgttaaaatgtcagactataacaaatatctatcttttatttttcattagacccttatacttcaagagaacacactcagtgcttgtttttattttcttgacacatttattaacaaaatgcatcatggaaaaaaaatctacctcttaaaattccatttgcttttatggttagacatgcttgaccaaaaatgttcagaagaaaatatgtacctggtccctaattaagctgcgttaaatttggtagaagcatttaaatggtctatcttcagttttactgaacaaaaaatgtaatttatttagcattctttataaaagaattgatgctagaggtaaaaaaaaatacttgtttttaaaaaatcctttacgtcttgtgtaattaccccattattaaattcaagtccttgaaaatcaactagagattataaagtctctaaagaaggcaataacaaaatttatcaagatatagtacttttcagtttttgtttagtgtcttcagcatcactgtgtctgtatttcaagtacaaatgtttttaaaaaggattctttatacatatgtgctgaattgattttaagaaagttgcatgatcctgtaggagcaacatttttacctaaaaaatgctaactttatagtatttctaattgttcaaggattttaaaattctatttcagggagtatatcttctgtggttttgaaggaggtgagttctgtatgtgccttgcagtactgtaattcaaaaataggaatctttggctgcaaaattttaatgaaatgttaggaagtaattttcgtgctaacattaaaattataactttttgaaaggtaatagattttccagaagtaaaatctgatggttctaaatcaatcaatgtgatagttcatttttaactcttagaagaattcagaggaaattaacccagctaagtaaaaaatctgtcttgattttgttacttattcctcagaatattaaacattgatcacataaaaaaaaaaaaaaaaaaaa

SEQ ID NO: 625 - DNA, 9018 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggtaaaaaaagccaccagtgtgcagcagatagaaatggaagagagcaaagagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagcatttgattaaaaat

SEQ ID NO: 626 - DNA, 8976 bp, Homo sapiens
cttttctcaagacaactacataagcagacaaaattgcaaagatctgccctgtgtcgagtatgacagccacgactcgtggctctccggtcggagggaatgacaaccagggccaggctcctgatggacagtctcagccccccctccaacagaatcagacttcatcgcctgattcttccaatgaaaattccccggcaactcccccagatgagcaaggtcaaggtgatgccccaccacagcttgaagatgaggaacctgcatttccacatactgacttggccaagttggatgacatgatcaacaggcctcgatgggtggttccagttttgccgaaaggggaattagaagtgcttttagaagctgctattgatcttagtaaaaagggccttgatgttaaaagtgaagcatgtcagcgatttttccgtgatgggctaacaatatcattcactaaaattcttacagatgaagcagtgagtggctggaagtttgaaattcataggtgtctggtggagctatgtgtggccaagttgtcccaagactggtttccacttttagaacttcttgccatggccttaaatcctcattgcaaattccatatctacaatggtacacgtccatgtgaatcagtttcctcaagtgttcagttgcctgaagatgaactctttgctcgttctccagatcctcgatcaccaaagggttggctagtggatcttctcaacaaatttggcactttaaatgggttccagattttgcatgatcgttttattaatggatcagcattaaacgttcaaataattgcagcccttattaaaccatttgggcaatgctatgagtttctcactcttcatacagtgaaaaagtactttcttccaataatagaaatggttccacagtttttagaaaacttaactgatgaagaactgaaaaaagaagcaaagaatgaagccaaaaatgatgctctttcaatgattattaaatctttgaagaatttagcttcaagggttccaggacaagaagaaactgttaaaaacttagaaatatttaggttaaaaatgatacttagattattgcaaatttcttctttcaatggaaagatgaatgcactgaatgaagttaataaggtgatatctagtgtatcatactatactcatcgacatggtaatcctgaggaggaagagtggctcacagctgaacgaatggcagaatggatacagcagaacaatatcttatccatagtgttgcgagatagtcttcatcagccacagtatgtagaaaagttagagaagattcttcgttttgtcatcaaagaaaaagctctgaccttacaggatcttgataatatctgggcagcacaggcagggaaacatgaagccattgtgaagaatgtacatgatctcctggcaaaattggcatgggatttttctcctgaacaacttgatcatctttttgattgttttaaggccagttggacaaatgcgagtaaaaagcaacgtgaaaagctacttgagctgatacgtcgtcttgcagaagatgataaagatggtgtgatggcacacaaagtgttgaaccttctgtggaatctggctcacagtgatgatgtgcctgtagatatcatggacctggctctcagtgcccacataaaaatactagattacagttgctcccaggaccgtgatacacaaaagatccaatggatagatcgctttatagaagaacttcgcacaaatgacaaatgggttattcccgcactgaaacaaattagagaaatttgtagtttgtttggtgaagcgcctcaaaatttgagtcaaactcagcgaagtccccatgtgttttatcgccatgacttaatcaatcaacttcaacacaatcatgccctagttactttggtagcagaaaaccttgcaacttacatggaaagcatgagactatatgctagagaccatgaagattatgacccacaaactgtgaggctgggaagtagatatagtcatgttcaagaagttcaagaacggcttaacttccttagatttttattgaaggatggtcagctgtggctatgtgctcctcaggcaaaacaaatatggaaatgcttagctgagaatgcagtttacctttgtgatcgtgaagcctgttttaagtggtattccaagttgatgggggatgaaccagacttagatcctgatattaataaggacttctttgaaagtaatgtgcttcagcttgatccttctctgttaactgaaaatggaatgaagtgttttgagcgattcttcaaagctgtgaattgtcgagaaggaaaactagtagcaaaaaggagagcctatatgatggatgacttggagttaataggattagattacctttggagggtcgtgattcagagtaatgatgatattgccagcagagctatagatctcctcaaagagatatacacgaaccttggtccaagactacaagtcaatcaggtggtgatccatgaagacttcattcagtcttgttttgatcgtctgaaggcttcctatgacacattgtgtgttttggatggtgacaaagacagtgttaattgtgcaagacaggaagctgttcgaatggttcgagtattaactgttttaagggaatatataaatgaatgtgacagtgattatcatgaggaaagaacaattctccctatgtcgagagcattccgcggtaaacacctctcttttgtagttcgatttccaaaccagggcagacaggttgatgacttggaggtatggtctcatacaaatgatacaattggttcagtacgacgatgtattctcaatcgtattaaagccaacgtagcccatacaaaaattgagctctttgtgggcggtgagctgatagatcctgcagatgatagaaagttgattggacaattaaacttaaaagataaatcgcttattacagccaaacttacacagataagttccaatatgccttcaagccctgatagctcttctgattcctccactggatctcctggaaaccatggtaatcattacagtgatggtcccaatccagaagtggaaagctgtttgcctggagtgataatgtcactgcatcccagatacatctcttttctttggcaagttgcagacttaggtagcagcctaaatatgccaccccttagagatggagcaagagtacttatgaaacttatgccgccagatagcacaacgatagaaaaattaagagctatttgtttagaccatgccaaacttggagaaagcagccttagtccatctcttgactcacttttctttggtccttcagcctcacaagtgctatatctaacagaggtagtctatgccttgttaatgcctgctggtgcacctctggctgatgattcctctgattttcagtttcacttcttgaaaagtggtggcctaccccttgtactgagtatgctaaccagaaataacttcctaccgaatgcagatatggaaactcgaaggggtgcctacctcaatgctcttaaaatagccaagcttttgctaactgccattggctatggtcatgttcgagctgtggcagaagcttgtcagccaggtgtagaaggtgtgaatcccatgacacagatcaaccaagttacccatgatcaagcagtggtgctacaaagtgcccttcagagcattcctaatccatcatccgagtgcatgcttagaaatgtgtcagttcgtcttgctcagcagatatctgatgaggcttcaagatatatgcctgatatttgtgtaattagagctatacaaaaaattatctgggcatcaggatgtgggtcgttacagctagtatttagcccaaatgaagaaatcactaaaatttatgagaagaccaatgcaggcaatgagccagacttggaagacgaacaggtttgctgtgaagcattggaagtgatgaccttatgttttgccttgattccaacagccttagatgctcttagtaaagaaaaggcttggcagacattcatcattgacttactattgcactgtcacagcaaaactgttcgtcaggtggcacaggagcagttctttttaatgtgcaccagatgttgcatgggacaccggcctctacttttcttcattactctactctttactgttttggggagcacagcaagagagagagctaaacactcaggcgactactttactcttttaagacaccttcttaattacgcttacaatagtaatattaatgtacccaatgctgaagttcttctcaataatgaaattgattggcttaaaagaattagggatgatgttaaaagaacaggagaaacgggtattgaagagacgatcttagagggccaccttggagtgacaaaggagttactggcctttcaaacttctgagaaaaaatttcatattggttgtgaaaaaggaggtgctaatctcattaaagaattaattgatgatttcatatttcctgcatccaatgtttacctacagtatatgagaaatggagagcttccagctgaacaggctattccggtctgtggttcaccacctacaattaatgctggttttgaattacttgtagcattagctgttggctgtgtgaggaatctcaaacaaatagtagattctttgactgaaatgtattacattggcacagcaataactacttgtgaagcacttactgagtgggaatatctgccacctgttggaccccgcccacccaaaggattcgtggggctgaaaaatgccggtgctacttgttacatgaattctgtgattcagcaactctacatgattccttccattaggaacggtattcttgccattgaaggcacaggtagtgatgtagatgatgatatgtctggggatgagaagcaggacaatgagagcaatgttgatcccagggatgatgtatttggatatcctcaacaatttgaagataaaccagcattaagtaaaactgaagatagaaaagagtacaacattggtgtcctaagacaccttcaggtcatctttggtcatttagctgcttctcgactgcaatactatgtgcccagaggattttggaaacagttcaggctttggggtgagcctgttaatctgcgtgaacaacacgatgctttagaattttttaattcattggtggatagtttagatgaagctttaaaagctttaggacatccagctatgctaagtaaagtcttaggaggttcctttgctgatcagaagatctgccaaggctgcccacataggtacgaatgtgaagaatcttttacgaccctaaacgtagacattagaaatcaccaaaatcttcttgattctttggaacagtatgtcaaaggagatttactagaaggtgcaaatgcatatcattgtgaaaaatgcaataaaaaggttgataccgtaaagcgcttgctgattaaaaaattacctcctgttcttgctatacaactaaagcgatttgactatgactgggaaagagaatgtgcaatcaagttcaatgattattttgaatttcctcgagagctggacatggaaccttacacagttgcaggtgtcgcaaagctggaaggggataatgtaaacccagagagtcagttgatacaacagagtgagcagtctgaaagtgagacagcaggaagcacaaaatacagacttgtgggtgtgctcgtacacagtggtcaagcgagtggggggcattattattcttacatcatccaaaggaatggtggagatggtgagagaaatcgctggtataaatttgatgatggtgatgtaacagaatgtaaaatggatgatgacgaagaaatgaaaaaccagtgttttggtggagagtacatgggagaagtgtttgatcacatgatgaagcgtatgtcatacaggcgccagaaaaggtggtggaatgcttatatacttttttatgaacgaatggacacaatagaccaagatgatgagttgataagatatatatcagagcttgctatcaccaccagacctcatcagattattatgccatcagccattgagagaagtgtacggaaacagaacgtacaattcatgcataaccgaatgcagtacagtatggagtattttcagtttatgaaaaaactgcttacatgtaatggcgtttacttaaaccctcctcccgggcaagatcacctgttgcctgaagcagaagaaatcactatgatcagtattcaacttgctgctaggttcctctttactacaggatttcacacaaagaaagtagtccgtggctctgccagtgattggtatgatgcattgtgtattctccttcgtcacagcaagaatgtacgtttttggtttgctcataacgtcctttttaatgtttcaaatcgcttctccgaataccttctggagtgccctagtgcagaagtgaggggtgcgtttgcaaaacttatagtctttattgcacatttttccttgcaagatgggccatgtccttcaccttttgcctctcctggaccttctagtcaggcttatgacaacttaagcttgagtgatcacttactaagagcagtactaaatctcttgagaagggaagtttcagagcatgggcgtcatttacagcagtatttcaacctgtttgtaatgtatgccaatttaggtgtggcagagaagacacagcttctgaaattgagtgtacctgctacttttatgcttgtgtctttagatgaaggtccaggtcctccaatcaaataccagtatgctgaattaggcaaattatactcagtagtgtcacagctgatccgctgttgcaatgtctcttcaagaatgcagtcttcaatcaatggtaatcctcctcttcccaatccttttggtgatcctaatttatcacaacctataatgccaattcagcagaatgtggcagacattttatttgtgagaacaagttatgtgaagaaaatcattgaagactgcagtaattcagaggaaaccgtcaaattgcttcgtttttgctgctgggagaatcctcagttctcatctactgtcctcagtgaacttctctggcaggttgcatattcctatacctatgaactgcggccctatttggatctgcttttgcaaatcttactgattgaggactcctggcaaactcacagaattcataatgcactgaaaggaattccagatgaccgagatgggctgtttgacacaatccagcgctctaagaatcactatcaaaaaagagcataccagtgtataaaatgtatggtagctctatttagtaactgtcctgttgcttaccaaatcctgcagggcaatggagatcttaaaagaaagtggacctgggcagtggaatggcttggagatgaacttgaaagaagaccatatactggcaatcctcagtacacttacaacaattggtctcccccagtgcaaagcaatgaaacgtccaatggttatttcttggagagatcacatagtgctaggatgacacttgcaaaagcttgtgaactctgtccagaggaggagccagatgaccaagatgctccagatgaacatgagtcgcctccacctgaagatgccccattgtacccccattcacctggatctcagtatcaacagaataaccatgtgcatggacagccatatacaggcccagcagcacatcacatgaacaaccctcagagaactggccaacgagcacaagaaaattatgaaggcagtgaagaagtatccccacctcaaaccaaggatcaatgaaatgcacataattaactggttccatcaagactgtgcacccaggccttacagtccaacctttttctgtgtctggctaatatttaaaactagaaaaactattcctaatcaacatggagtggagagtttattcactgtcttatctgcagaaatttgctgtcaatatataacccgcctgcagtggaaagtgtatagtgttttgtaataaatggcctgatgctaatgtgtaaatggcaaaggtgtatatagtatattaatgttgactgttaattcttaagcaagaaacttttttcttgatgagactcacagatctacacaaactacaaaagttaattttcttgttacacccactgcactctgcaaccagtgttgcctgcctcatggcagttggatcagctcctttacaaaaaagaaaaaaaaaaaaccaacagcaacaaaacagagcccatccatgtcagccacaccaatagtttcatgttaattctttgccactggagtcaattttgctatgagcaatgtaaggctggtaacctttaaattatttggttgatgtggaaaattggtgatgtaacactgtttctagatttttttcattgcctttttattctgatattaggttaatcactttgaagctatagttatgctgtaacatttagcatggcttcacaccaagttagtgtagccaatgaggaaaaagttaccataatgacagcagttgtccgagaagtgacagctgtattactcagagcttttacttcttacacctagaatattaaaatataaaacaaggggagaaatgtgacagtctattttcagttgcacatatgttccttatatataatgtttgacagttcaatctctgggtggaataaagaacacttacgtatcagtaatgggaatttttaaagatttaaaacaaatatgcaaaaatttgctatgccaagatgctggagcataatataagactgtatttggtgtgcttgttttgtttctttggtagagtttattaggtgaatcttctaaaactttccttctgttggatcccagtgacgtggaagtcatcagaaccccacggtacttggagtacctctctgcaccaagatagctggctgattttctgctcagtcacaattttacttgaaagcaagaattgtcctagctccttttccattattccaaaacgtttaacgttcaaagcagggtctcattaaaaaagaaactactggttgatataattgagatattacaatttcagaataaacatttgattaaaaat

SEQ ID NO: 627 - DNA, 4684 bp, Homo sapiens; identical to SEQ ID NO: 624

SEQ ID NO: 628 - DNA, 1574 bp, Homo sapiens
cagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagtcaggacccttaattaagatcctcaattggctggagggcagatctcgcgagtagggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaaaaaaaaaaaaaaaaa

SEQ ID NO: 629 - DNA, 1501 bp, Homo sapiens
cagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaaaaaaaaaa

SEQ ID NO: 630 - DNA, 1511 bp, Homo sapiens
cagacagaccaatcacgcgcattcttcggccacgacaagcgcgcctctgatcacgtgaccaggtccgctacccacgtgggggctcagcgtgcacccttctttgtgctcgggttaggaggagctaggctgccatcgggccggtgcagatacggggttgctcttttgctcataagaggggcttcgctggcagtctgaacggcaagcttgagcaacgcggtaaaaatattgcttcggtgggtgacgcggtacagctgcccaagggcgttcgtaacgggaatgccgaagcgtgggaaaaagggagcggtggcggaagacggggatgagctcaggacagagccagaggccaagaagagtaagacggccgcaaagaaaaatgacaaagaggcagcaggagagggcccagccctgtatgaggaccccccagatcagaaaacctcacccagtggcaaacctgccacactcaagatctgctcttggaatgtggatgggcttcgagcctggattaagaagaaaggattagattgggtaaaggaagaagccccagatatactgtgccttcaagagaccaaatgttcagagaacaaactaccagctgaacttcaggagctgcctggactctctcatcaatactggtcagctccttcggacaaggaagggtacagtggcgtgggcctgctttcccgccagtgcccactcaaagtttcttacggcataggcgatgaggagcatgatcaggaaggccgggtgattgtggctgaatttgactcgtttgtgctggtaacagcatatgtacctaatgcaggccgaggtctggtacgactggagtaccggcagcgctgggatgaagcctttcgcaagttcctgaagggcctggcttcccgaaagccccttgtgctgtgtggagacctcaatgtggcacatgaagaaattgaccttcgcaaccccaaggggaacaaaaagaatgctggcttcacgccacaagagcgccaaggcttcggggaattactgcaggctgtgccactggctgacagctttaggcacctctaccccaacacaccctatgcctacaccttttggacttatatgatgaatgctcgatccaagaatgttggttggcgccttgattactttttgttgtcccactctctgttacctgcattgtgtgacagcaagatccgttccaaggccctcggcagtgatcactgtcctatcaccctatacctagcactgtgacaccacccctaaatcactttgagcctgggaaataagccccctcaactaccattccttctttaaacactcttcagagaaatctgcattctatttctcatgtataaaactaggaatcctccaaccaggctcctgtgatagagttcttttaagcccaagattttttatttgagggttttttgttttttaaaaaaaaattgaacaaagactactaatgactttgtttgaattatccacatgaaaataaagagccatagtttcaaaaaaaaaaaaaaaaaaaa

SEQ ID NO: 631 - DNA, 5094 bp, Homo sapiens
atgcgcctgactcacatctgctgctgctgcctcctttaccagctggggttcctgtcgaatgggatcgtttcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctgatgggatttatacagctcaatgaggacttcatatttattgagccactcaatgatacaatggccataacaggtcacccacaccgtgtatataggcagaaaaggtccatggaggaaaaggtcacagagaagtcagctcttcacagtcattactgtggtatcatttcagataaaggaagacctaggtctagaaaaatagcagaaagtggaagagggaaacgatattcatacaaattacctcaagaatacaacatagagactgtagtggttgcagacccagcaatggtttcctatcatggagcagatgcagccaggagattcattctaaccatcttaaatatggtatttaaccttttccaacacaagagtctgggtgtgcaggtcaatcttcgtgtgataaagcttattctgctccatgaaactccaccagaactatatattgggcatcatggagaaaaaatgctagagagtttttgtaagtggcaacatgaagaatttggcaaaaagaatgatatacatttagagatgtcaacaaactggggggaagacatgacttcagtggatgcagctatacttataacaaggaaagatttctgtgtgcacaaagatgaaccatgtgatactgttggtatagcttacttgagtggaatgtgtagtgaaaagagaaaatgtattattgctgaagacaatggcttgaatcttgcttttacaattgctcatgaaatgggtcacaacatgggcattaaccatgacaatgaccacccatcgtgtgctgatggtcttcatatcatgtctggtgaatggattaaaggacagaatcttggtgacgtttcatggtctcgatgtagcaaggaagatttggaaagatttctcaggtcaaaggccagtaactgcttgctacaaacaaatccgcagagtgtcaattctgtgatggttccctccaagctgccagggatgacatacactgctgatgaacaatgccagatcctttttgggccattggcttctttttgtcaggagatgcagcatgttatttgcacaggattatggtgcaaggtagaaggtgagaaagaatgcagaaccaagctagacccaccaatggatggaactgactgtgaccttggtaagtggtgtaaggctggagaatgtaccagcaggacctcagcacctgaacatctggccggagagtggagcctgtggagtccttgtagccgaacctgcagtgctgggatcagcagtcgagagcgcaaatgtcctgggctagattctgaagcaagggattgtaatggtcccagaaaacaatacagaatatgtgagaatccaccttgtcctgcaggtttgcctggattcagagactggcaatgtcaggcttatagtgttagaacttcctccccaaagcatatacttcagtggcaagctgtcctggatgaagaaaaaccatgtgccttgttttgctctcctgttggaaaagaacagcctattcttctatcagaaaaagtgatggatggaacttcttgtggctatcagggattagatatctgtgcaaatggcaggtgccagaaagttggctgtgatggtttattagggtctcttgcaagagaagatcattgtggtgtatgcaatggcaatggaaaatcatgcaagatcattaaaggggattttaatcacaccagaggagcaggttatgtagaagtgctggtgatacctgctggagcaagaagaatcaaagttgtggaggaaaagccggcacatagctatttagctctccgagatgctggcaaacagtctattaatagtgactggaagattgaacactctggagccttcaatttggctggaactaccgttcattatgtaagacgaggcctctgggagaagatctctgccaaaggtcctactacagcacctttacatcttctggtgctcctgtttcaggatcagaattatggtcttcactatgaatacactatcccatcagaccctcttccagaaaaccagagctctaaagcacctgagcccctcttcatgtggacacacacaagctgggaagattgcgatgccacttgtggaggaggagaaaggaagacaacagtgtcctgcacaaaaatcatgagcaaaaatatcagcattgtggacaatgagaaatgcaaatacttaaccaagccagagccacagattcgaaagtgcaatgagcaaccatgtcaaacaaggtggatgatgacagaatggaccccttgttcacgaacttgtggaaaaggaatgcagagcagacaagtggcctgtacccaacaactgagcaatggaacactgattagagcccgagagagggactgcattgggcccaagcccgcctctgcccagcgctgtgagggccaggactgcatgaccgtgtgggaggcgggagtgtggtctgagtgttcagtcaagtgtggcaaaggcatacgtcatcggaccgttagatgtaccaacccaagaaagaagtgtgtcctctctaccagacccagggaggctgaagactgtgaggattattcaaaatgctatgtgtggcgaatgggtgactggtctaagtgctcaattacctgtggcaaaggaatgcagtcccgtgtaatccaatgcatgcataagatcacaggaagacatggaaatgaatgtttttcctcagaaaaacctgcagcatacaggccatgccatcttcaaccctgcaatgagaaaattaatgtaaataccataacatcacccagactggctgctctgactttcaagtgcctgggagatcagtggccagtgtactgccgagtgatacgtgaaaagaacctatgtcaggacatgcggtggtatcagcgctgctgtgaaacatgcagggacttctatgcccaaaagctgcagcagaagagttgacctctagcaggctggctggatcacagctcttggcaattacattatttataaacacacacactagcatgtttttcagaccaaatattatcagattacatataatttaatcaaattaatttatttttttgcctgccaaacatccaatgtggtgcttgttttggttacacaaacattttgatttatactatatggcttcataaataattttatatgaatgaattagttggatccagtaatataataaaaagaaaaaggaaaaaaatagatcattatacttaaaacaagttttcgttgtttgttagggctatctctaaggtgctactctctccccaccaataacattgaattatccagaatgtatactgacttagcataatagtttaggtgtatatgaagagaaactatttttgttttttggtgtcctgctgcagaattagcccattttctgtcacctgcaggagatgtgtaaacataatgaacctcatgctgttgaacaggtttttagagaatgtattatgaatttggttcagatttatagacatccataggaaaaattctgctgtaattataaccttattttgatatggaaaagaaaagtcaaaatagagactttgatcatgttcatgaacatgtacttgaacacaagtattgtaacaatgaaacactgtaatgatttacactgaatcacaattgcactgttgatatagtgtagagaaatcgttagaaatggtgacatcttacaaaaaatgtgtattattttaacatgttatcactagattttagctttttttaaatatttttaacaaagaaaacattgatccacccatttccctgtatctttttagcagatttattaaagagtatagtacttagcctcacgaatcataattagaaaatttactagtatttctcagccttttccctaggaacaaggaaaaacagaaagcatataatacggtggtcgtttcattgtgtttttcttccttttaaaaattaaaaagttttacaattatgtgaaacgttcaaaagccagcttaaaatttttcttgtgagaaaatattatacatgattcacatgatttcttagatttttcaataaaatatgtaaaacttcccactgagagacaattcttcatagacttgtcacatatccacatgtctgatgaacaaaggtactgtctacttttgttctggagtatcttctagaggatgtttatagagtgaactgccttggaagatagtatgtctcttgggagcaaagggcaaacatacttctcattataaaagtttcaggttccctaaaattggggtttctttactataagacaatccaatgtatgttctgaggtcacctggctctcttcatgtcaccctttgggaaatggggctcaacgagccagtacaggaaaagctgattccctggctactactatcgctgtgagtaataaagtcctttgtctttaatgaaaaa

SEQ ID NO: 632 - DNA, 2744 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgt

SEQ ID NO: 633 - DNA, 3347 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaaaaaaaaa

SEQ ID NO: 634 - DNA, 2636 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtaagtctgaacctctaatggaaaaaggcactccaaggtcctgtgcaaatagtgtcaaaagtaaattaagcagatagtcaaagaactgt

SEQ ID NO: 635 - DNA, 3393 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagtatttaaacccatggttcaaaagagactataatgtagctaagtgggtagaagatgtgaataaaaacactgaaggaccatactttaggactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttacttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaaaaaaaaa

SEQ ID NO: 636 - DNA, 3455 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaaaaaaaaa

SEQ ID NO: 637 - DNA, 1281 bp, Homo sapiens
atgggcagcagagtagtggaacagcacaaatatggtggtgttggcattgcttcattctcatgtactccagaagacatgatgataatgttcacagaaacattatttgtaatggccaccaaatggaaacaatccaattgtccatccataataaaacagatggtaatatgttggctttttccagaaagaatgctgtcttcctgtgcctgcggagatgataatcaagctggcacactgacaatcaatgtaaattcattaaacaaaacaggaagtaaacaggtcacgctgatttacaccggcgatcgcaaggtcgacggcaacccttacgaaaagcttccgaaagatgtgcgtgctgatttccagacgcgtatcgatgccactcgtcagatgtttgccgaaaaggtttccgcttataccggcatgtctgttcaggacgtgctggacaccgaagcggcagtattctccggccaggaatctttggataacgggctggcggatgaacttgttaacaataccgatgcgctcggcgtgatgcgcgaagcactcgacagacgcaaaaaaacaacccttggaggaactatgccatcaccttctgcatcagctgtgaccactaagccagttgaccaggcagcaactcagacaactgcatcagctgaacaggccactaccgttgacacgacaattgcttccgtagcagcccctgtagatgtcagtgcgcaggttactgcagcagtagctgcagagaatagtcgcatcatgggcatcctgaactgcgacgaggctaaagggcgtgagtcacaggcgcgagcactggccgaaacgccgggtatgacggtagagagcgcacagcgcattctggctgctgcaccgcaaagtgcccagatgcgtaccgatacggcgctggatcgtttgatggaaacagcacccggtgcactccaagcagaggctatcatggcaattactgaagttttcacacataaccagccgctcggtaacagcgacccggcgcacactgcgtatggtcctggcgaactgacggcttccactccagccatgacgccgctcatgctggatgccacttctggcaagctgaccgtctgggatggtgctcatgctggcgcggcaatgggcatcctggctgtaaccgcagaccagaacagcgcggaactggcatattacaaatctggctctttccgtattgaagatgtcctctggccatctgccgtcaccgacgacaacattaaacgtaacgcgttcgccggtactgcaatcagcatcgtttaa

SEQ ID NO: 638 - DNA, 2340 bp, Homo sapiens
atgggaggggcgcggggagggggcttcgcgcccgggagtgggcgggacgcggtcttggctccgcccccaggggcagccggcggagcactatacggccactgttctccgagacacaaagagggccttgttttgggtgtggcctcctggaagagagatggggagtacaggctgctccacaccgtccctgggcttccttctagggcgtcctgggataggcgcggccggcatagcgctgggggtgcgggtggaaataatagcagcagtgttagcgccttgcttaaaaaccttcaagtggtttataattgccttgtgaattatttccttactctgtcatttaaggctcagactgctgtcttttacaaactcagccaatataattacctaacattttttggccatttcttatttaacccagatgtcaccaaggaaatcttcactctgagacagaatgagcttgagtgcacagtctatactacagatttgacttgctgtgtctttataccagagactgaaagaagaaaagaaaaacctaagcccacccattactctggcaaaacttttaatcaaaacactcccatcgatttcctagctttctccttcaaccaacaaagaaagctccatcatggtggctccataacggctgtaggcgatcccccggtgcaggcgaggatcacactcttgctgctctgtctgggagtgtttctgttcctttctggatggccccagattgcacactgtcaataccacagccccccagaagtggtgatacctgtcaggataactggcatttgtagaaacataaagcttccaggctggctctcatatagcctgtgctttggggaacagagacacattgtccacatgaaggccaagaagaatctgatatccagatacctttctgtgttcagttacactgatcagggtgctctccttgagaaccaaccttttgtccaaagtgattgctactaccatggttatatggaaggggacccagagtccctggttgctctcagcacctgttttgggaaaaggaatatttcaaatgtgccgaaggatgtaagccttattatcaatgaactagatgccttttattcttcagtagaagttgttgtggttttacttggaattgagatttcgatcgaaggaaaccccatagcaataaatgacctatatgcagtcctgccagaattttgcaaatggaagaaggtcagcttaaattcccacataaaacatgatgctgtacatcttattgtgaagaaaggatatggtagatttgctggcttatcctacctcggaacaggatgtagtcttgctggtaattgtggagttgttagtttcctggatgaccaaatgcttacatttgcattcattatggcacatgagcttggccatactttgggtacgccacatgatagaatcccatgtacatgtgcggagaaaatatgcataatgtgtccgacagtaaacatcacatataggttcagcaactgctgttacgagatgttgttcgcaaccactgtgaaaacgacctgtttgcgtggttcgccaaatccagagaacatcttcacacacaagtactgtgggaacggtgtgtttgaggaaggagaggagtgtgactgtggatccttattcttgtgtactcaagatctgtgttgtttggcaaactgtactctgaaacctggggctgcttgcgcttttggactttgttgcaaagactgccagtttcttccatcaggacactggtgtagagaaaagcacaatgaatgtgatctttcagagtggtgcgacggaactttgcataattgtccagaagatgtgtatgtgcaggatggccttggtagcatggacagtggctaccgctgtcaaaaggcatgtagaaaccatgatggacagcgtaaacacatttttgagaaggtagccaagagtgcaaatcagagttgctacagggtgaacaccgacgatatcctgtgtgggagagttcagtgtgagaatgtgacagaaattcccattccgagagatcattctatgatgcactgggctcacttcaacggcatcaactgctggagtactgactaccattttggaatgaccgtacctgatattggtgaaattaaagatggcacagagtgtggttcaaaacatgtgtgtacacataggaagtgtgtccctctgccatttgaggaaagtacttgctcacctgagacctgtaatatgagaggcatctgcaacaataaacatcgtcattgcaattataagtgggccccaccctactgcctgttaaaaggcacaggaggaagtgttgacagtggcccatcccctaggaaaaaaacaaaactatga

SEQ ID NO: 639 - DNA, 1320 bp, Homo sapiens
atggggcgcctgcaactggttgtgttgggcctcacctgctgctgggcagtggcgagtgccgcgaaggaagctgaaagccgagctactccacacccggaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggaggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagagtgccaagacctacgcctacctgttttcccatccctctcggatgcccgtctaccccaaatgggtgggggccgaccatagagatgagatccagacagtctctaaggctatgaccgcctactggaccaactttgccaaaacaggggaccccaacatgggccactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccgtctcccccgacaggcaactccgagtctgcccccgtgactctgaggctcccccgtaccccctacgggtgactctgaggcccgtgcccaccttgggtgacactgaggctgcccctgtgtcccccacagatgactccgaggaagctcagatgctgcagtcattagtttctagtgtcccatcagccttgactccagatgatgaagttgaaaatactgacaggctggaggccatctggggtcctgctggctcccagttccaggaagcctggaagagcactggggtgagctcgggccagcgcatgtttactgtcacaggggacatgtttcagcactttcattgtaaggctgtggccttctgtgcttgtggatcctcagtctcagtggccttcctcttccccccaccccaactcctgtgttgcgtgtttaacacacctacgcccaaccgggacataactaaatcctag

SEQ ID NO: 640 - DNA, 2094 bp, Homo sapiens
gcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaactaaaaaaaaaaaaaaaaaaaaaaaaaaaaaa

SEQ ID NO: 641 - DNA, 3694 bp, Homo sapiens
cagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtaaaggttgttgctgttgatgcagagttgaatgtcttctatgaggaaagtgtgcattttgacagagatcttccagaatttgggactcagggcggtgttcatgtgcacaaggatgggctgacggtcacttctccagtactaatgtgggtccaggcactggatatcatcttggagaagatgaaggcttcgggcttcgacttctctcaagtcctagccttgtccggggcgggccagcaacacggaagtatatactggaaggctggagcccagcaggcactgacaagcttatcaccagacctccggctacaccagcagcttcaggactgtttctccatcagcgactgcccggtgtggatggactccagcaccacagcccagtgccgccagctggaggctgctgtgggtggtgctcaggctctcagctgcctcacggggtcccgtgcctatgagcgttttacagggaaccaaattgcaaaaatttaccagcagaaccccgaggcctactcacatacagagagaatttctttggtcagtagctttgctgcttccctgttccttggctcttactcccctattgactacagtgatggttctggaatgaatttgttgcagatacaggataaagtctggtcccaggcttgccttggtgcctgtgcacctcatttagaggagaagcttagcccaccagtaccatcatgctcagttgtgggagccatttcttcctactacgtccagcgctacggatttcctccaggatgcaaagtggtggccttcactggggacaacccagcgtcgctggcaggcatgagactggaggaaggtgacattgcggtcagcctgggcaccagtgacaccctgtttctctggctccaagagcccatgcctgccctggaaggccacatcttctgcaacccggttgactcccagcactacatggcactcctgtgctttaaaaatggctccctcatgagagagaagatccgcaacgagtctgtatcccgttcctggagcgatttctctaaggcactgcagtccacagagatgggcaacggtggaaacctgggtttttattttgatgtaatggagatcacccctgaaattattggacgtcataggtttaacacagaaaaccacaaggttgcagcattccctggggatgtggaggttcgagcactaattgaaggacaattcatggccaagaggattcacgcagaaggcctgggctatcgagtcatgtccaagacaaagattttggccacaggaggagcatctcacaatagagaaatcttacaggtgcttgcagatgtgtttgatgccccggtgtatgttatagacactgccaactcggcctgtgtgggttctgcataccgagcttttcatggtcttgcaggtggaacagatgtgcccttttcagaggttgtgaagttagctccaaatcccagactagctgctaccccaagcccgggagcttctcaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttgg

SEQ ID NO: 642 - DNA, 2913 bp, Homo sapiens
gttggtaaacagatccggagcgcgtggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgattgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccaatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgaaaaaaaaaaaaaaaaaaaaaaaaaaaaaaaaaaaaaaaaaa

SEQ ID NO: 643 - DNA, 2507 bp, Homo sapiens
tggcgggcgtcagcgcggtggccagcgcgcagaggcgggcgcggaggcggctagaaggtgaccgcggatcccagcttcctgcagccagccctgaaggatggctgccatattgggagacaccatcatggtggctaaaggccttgtcaagctgacccaggcggccgtggaaacccacctgcagcacttgggcatcggaggggagctgatcatggcggccagggccctgcagtccacggctgtggagcagattggcatgttcttggggaaggtgcagggtcaggataaacatgaagaatattttgctgagaacttcggcggcccagaaggggagttccacttctcagtcccgcatgcagccggagcctccacagacttctcttcagcctccgctcccgaccagtcagcgcccccatccctgggtcatgcccacagcgagggcccagctcctgcctacgtggccagtggaccctttagagaagccgggttccccggccaggcctcctcccctctgggcagggccaacgggaggctctttgcaaaccccagagactcattctctgccatgggctttcagcgaaggttcttccaccaggaccaatcccctgttgggggcctcacagccgaggacattgagaaggcccggcaggctaaggctcgccccgagaacaagcagcacaaacagacgctcagcgagcatgcccgggagcggaaggtgcctgtgacgaggattggccggctggccaacttcggaggtctggccgtgggcctgggcttcggggcactggcagaggtcgccaagaagagcctgcgctccgaggacccctcagggaagaaggccgtgctgggttccagtcctttcctgtccgaggccaatgcagagcggatcgtgcgcacgctctgcaaggtgcgtggtgcggcactcaagctgggccagatgctgagcatccaggatgatgcctttatcaacccccacctggctaagatcttcgagcgggtgcggcagagcgcggacttcatgccactgaagcagatgatgaaaactctcaacaacgacctgggccccaactggcgggacaagttggaatacttcgaggagcggcccttcgccgccgcatccattgggcaggtgcacttggcccgaatgaagggcggccgcgaggtggccatgaagatccagtaccctggcgtggcccagagcatcaacagtgatgtcaacaacctcatggccgtgttgaacatgagcaacatgcttccagaaggcctgttccccgagcacctgatcgacgtgctgaggcgggagctggccctggagtgtgactaccagcgagaggccgcctgtgcccgcaagttcagggacctgctgaagggccaccccttcttctatgtgcctgagattgtggatgagctctgcagcccacatgtgctgaccacagagctggtgtctggcttccccctggaccaggccgaagggctcagccaggagattcggaacgagatctgctacaacatcctggttctgtgcctgagggagctgttcgagttccacttcatgcaaacagaccccaactggtccaacttcttctatgacccccagcagcacaaggtggctcttttggattttggggcaacgcgggaatatgacagatccttcaccgacctctacattcagatcatcagggctgctgccgacagggacagggagactgtgcgggcgaaatccatagagatgaagttcctcaccggctacgaggtcaaggtcatggaagacgcccacttggatgccatcctcatcctgggggaggccttcgcctctgatgagccttttgattttggcactcagagcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgat

SEQ ID NO: 644 - DNA, 2864 bp, Homo sapiens
cctggcgaaagcaagacgtggaggttttaccaggggttagtagcttcctcttgctaactttttattgggacaaaaggcaagatggcaccattctgttctcagatatttgtctaaataaagcccttttaattttattttatttttgttgtgggattcttaagcagataagaagaaaagacaccttcctagtgagcagctgcccagctcctgctcagttttgcctcggggtagcacctccagccacagaaagcaagccggtaagtctctccaggtaggacttgctgcaacccagctgctggactgatctgaaacgggactttgcatactctccgaagtatggtgagttggtgctgacttcaaagttgcctggtgaaggaagataaggtggatcgcagagactaaggggagagggagaagccctgctcctcttctccccaccaaggcacaatgagcaacatctgtcagaggctctgggagtacctagaaccctatctcccctgtttgtccacggaggcagacaagtcaaccgtgattgaaaatccaggggccctttgctctccccagtcacagaggcatggccactactttgtggctttgtttgattaccaggctcggactgctgaggacttgagcttccgagcaggtgacaaacttcaagttctggacactttgcatgagggctggtggtttgccagacacttggagaaaagacgagatggctccagtcagcaactacaaggctatattccttctaactacgtggctgaggacagaagcctacaggcagagccgtggttctttggagcaatcggaagatcagatgcagagaaacaactattatattcagaaaacaagaccggttcctttctaatcagagaaagtgaaagccaaaaaggagaattctctctttcagttttagatggagcagttgtaaaacactacagaattaaaagactggatgaagggggattttttctcacgcgaagaagaatcttttcaacactgaacgaatttgtgagccactacaccaagacaagtgacggcctgtgtgtcaagctggggaaaccatgcttaaagatccaggtcccagctccatttgatttgtcgtataaaaccgtggaccaatgggagatagaccgcaactccatacagcttctgaagcgattgggatctggtcagtttggcgaagtatgggaaggtctgtggaacaataccactccagtagcagtgaaaacattaaaaccaggttcaatggatccaaatgacttcctgagggaggcacagataatgaagaacctaagacatccaaagcttatccagctttatgctgtttgcactttagaagatccaatttatattattacagagttgatgagacatggaagtctgcaagaatatctccaaaatgacactggatcaaaaatccatctgactcaacaggtagacatggcggcacaggttgcctctggaatggcctatctggagtctcggaactacattcacagagatctggctgccagaaatgtcctcgttggtgaacataatatctacaaagtagcagattttggacttgccagagtttttaaggtagataatgaagacatctatgaatctagacacgaaataaagctgccggtgaagtggactgcgcccgaagccattcgtagtaataaattcagcattaagtccgatgtatggtcatttggaatccttctttatgaaatcattacttatggcaaaatgccttacagtggtatgacaggtgcccaggtaatccagatgttggctcaaaactatagacttccgcaaccatccaactgtccacagcaattttacaacatcatgttggagtgctggaatgcagagcctaaggaacgacctacatttgagacactgcgttggaaacttgaagactattttgaaacagactcttcatattcagatgcaaataacttcataagatgaacactggagaagaatatcaaataataaagtagcaaaacaaattcaaataatccattccaaaatacaatgttatcaaccaactgcacaatcagtttatcctgacatattcaagtgataggataaagttggccatgtattatgaaaaagattatttgtgcattttattgactgggcaacactgcaggacagtcaaggtgatatataatttcctcactgcctggtaaaattaagcacactaaaccaagttatttttctttttaagagatacttacatttccatttattgtttgaaatgtcgatcaagagaatcaacagatgatagtccaatttttactcagtgactgttgtagcattttcctgtttactgattagagtggttattcattattcctcagattgctgaatcccatcaggctgttattatgaaggaatttgattgctttgctgcacagcaggacctgtgctttgagatttttttttctcttttaaaatatcctgtaactacaatgatggtaaagccatgttaaatgacttgattgtacttggagtaattgcacatttttttctatgcataaaaaaatgatgcagctgttgagaaaacgaagtctttttcattttgcagaaggaaatgatggaatttttctgtacttcagtatgtgtcaactgagagtcatatacattagttttaatctcttaatattgagaatcaggttgcaaaacggatgagttattatctatggaaatgtgagaaatgtctaatagcccataaagtctgagaaataggtatcaaaatagtttaggaaaatgagaggagaacagtaggattgctgtggcctagacttctgagtaattaataaagaaaaagaagtaccctttggcctacaaaaaaaaaaaaaaaa

SEQ ID NO: 645 - DNA, 3240 bp, Homo sapiens
atggtctgttcggctgccccactgctgctcctggccacaactcttcccctgctggggtcaccagttgcccaagcatcccaacctgtaagtgagactggggtgagacccagggaaggtctgcagaggcgacaatggggacccctgattgggagagacaaagcatggaatgaaaggatagacagacccttccctgcctgccccatccccctatcttctagctttggccgatggcccaagggccagacaatgtgggcccagacctccaccctcaccctgacagaggaggagttgggacagagtcaggctggaggggaatctggatctgggcagctcctggaccaagagaatggagcaggggaatcagcgctggtctccgtctatgtacatctggactttccagataagacctggccccctgaactctccaggacactgactctccctgctgcctcagcttcctcttccccaaggcctcttctcactggcctcagactcacaacagagtgtaatgtcaaccacaaggggaatttctattgtgcttgcctctctggctaccagtggaacaccagcatctgcctccattaccctccttgtcaaagcctccacaaccaccagccttgtggctgccttgtcttcagccatcccgaacccgggtactgccagttgctgccacctgggtcccctgtcacctgcctccctgcagtccccgggatcctcaacctgaactcccagctgcagatgcctggtgacacgctgagcctgactctccatctgagccaggaggccaccaacctgagctggttcctgaggcacccagggagccccagtcccatcctcctgcagccagggacacaggtgtctgtgacttccagccacggccaggctgccctcagcgtctccaacatgtcccatcactgggcaggtgagtacatgagctgcttcgaggcccagggcttcaagtggaacctgtatgaggtggtgagggtgcccttgaaggcgacagatgtggctcgacttccataccagctgtccatctcctgtgccacctcccctggcttccagctgagctgctgcatccccagcacaaacctggcctacaccgcggcctggagccctggagagggcagcaaagcttcctccttcaacgagtcaggctctcagtgctttgtgctggctgttcagcgctgcccgatggctgacaccacgtacgcttgtgacctgcagagcctgggcctggctccactcagggtccccatctccatcaccatcatccaggatggagacatcacctgccctgaggacgcctcggtgctcacctggaatgtcaccaaggctggccacgtggcacaggccccatgtcctgagagcaagaggggcatagtgaggaggctctgtggggctgacggagtctgggggccggtccacagcagctgcacagatgcgaggctcctggccttgttcactagaaccaagctgctgcaggcaggccagggcagtcctgctgaggaggtgccacagatcctggcacagctgccagggcaggcggcagaggcaagttcaccctccgacttactgaccctgctgagcaccatgaaatacgtggccaaggtggtggcagaggccagaatacagcttgaccgcagagccctgaagaatctcctgattgccacagacaaggtcctagatatggacaccaggtctctgtggaccctggcccaagcccggaagccctgggcaggctcgactctcctgctggctgtggagaccctggcatgcagcctgtgcccacaggaccaccccttcgccttcagcttacccaatgtgctgctgcagagccagctgtttggacccacgtttcctgctgactacagcatctccttccctactcggcccccactgcaggctcagattcccaggcactcactggccccattggtccgtaatggaactgaaataagtattactagcctggtgctgcgaaaactggaccaccttctgccctcaaactatggacaagggctgggggattccctctatgccactcctggcctggtccttgtcatttccatcatggcaggtgaccgggccttcagccagggagaggtcatcatggactttgggaacacagatggttcccctcactgtgtcttctgggatcacagtctcttccagggcagggggggttggtccaaagaagggtgccaggcacaggtggccagtgccagccccactgctcagtgcctctgccagcacctcactgccttctccgtcctcatgtccccacacactgttccggaagaacccgctctggcgctgctgactcaagtgggcttgggagcttccatactggcgctgcttgtgtgcctgggtgtgtactggctggtgtggagagtcgtggtgcggaacaagatctcctatttccgccacgccgccctgctcaacatggtgttctgcttgctggccgcagacacttgcttcctgggcgccccattcctctctccagggccccgaagcccgctctgccttgctgccgccttcctctgtcatttcctctacctggccacctttttctggatgctggcgcaggccctggtgttggcccaccagctgctctttgtctttcaccagctggcaaagcaccgagttctccccctcatggtgctcctgggctacctgtgcccactggggttggcaggtgtcaccctggggctctacctacctcaagggcaatacctgagggagggggaatgctggttggatgggaagggaggggcgttatacaccttcgtggggccagtgctggccatcataggcgtgaatgggctggtactagccatggccatgctgaagttgctgagaccttcgctgtcagagggacccccagcagagaagcgccaagctctgctgggggtgatcaaagccctgctcattcttacacccatctttggcctcacctgggggctgggcctggccactctgttagaggaagtctccacggtccctcattacatcttcaccattctcaacaccctccagggcgtcttcatcctattgtttggttgcctcatggacaggaagatacaagaagctttgcgcaaacgcttctgccgcgcccaagcccccagctccaccatctccctggtgagttgctgccttcagatcctcagctgtgcatccaagagcatgtcagaaggcattccatggccctcctcagaggacatgggcacagccagaagctaa

SEQ ID NO: 646 - DNA, 5228 bp, Homo sapiens
ggatccggattcggattagcagcccgggaagagtgccgtggcacaggcgccggagggagcgcgaccctcggaccccgcctggcccgcggggctgggacccggccccggcctgcccgatggggcgcgcggccccggagatgcgccctcgcccggccccgcgcccccggccccgcgcccccggcccgcccgccccggcccgcgcctccgcctgagtcccccgcgccttggcccgccaccccccgccccgcgcccccggcccgcctgcgccatggagcccggccgcggcggcacagagaccgtgggcaagttcgagttctcccgcaaggacctgatcggccacggcgccttcgcggtggtcttcaagggccgccaccgcgagaagcacgatttggaggtcgccgtcaagtgcattaacaagaagaacctcgccaagtctcagacgctgctggggaaggaaatcaaaatcctgaaggaactgaaacatgaaaacatcgtggccctgtacgacttccaggaaatggctaattctgtctacctggttatggagtactgcaacggtggggacctggccgactacctgcacgccatgcgcacgctgagcgaggacaccatcaggctcttcctgcagcagatcgcgggcgccatgcggcttctgcacagcaaaggcatcatccaccgcgacctgaaaccgcagaacatcctgctgtccaaccccgccggccgccgcgccaaccccaacagcatccgcgtcaagatcgctgacttcggcttcgcgcggtacctccagagcaacatgatggcggccacactctgcggctcccccatgtacatggcccccgaggtcatcatgtcccagcactacgacgggaaggcggacctgtggagcatcggcaccatcgtctaccagtgcctgacggggaaggcgcccttccaggccagcagcccccaggacctgcgcctgttctacgagaagaacaagacgttggtccccaccatcccccgggagacctcggccccgctgcggcagctgctcctggccctactgcaacgcaaccacaaggaccgcatggacttcgatgagttttttcatcaccctttcctcgatgccagcccctcggtcaggaaatccccacccgtgcctgtgccctcgtacccaagctcggggtccggcagcagctccagcagcagctccacctcccacctggcctccccgccgtccctgggcgagatgcagcagctgcagaagaccctggcctccccggctgacaccgctggcttcctgcacagctcccgggactctggtggcagcaaggactcttcctgtgacacagacgacttcgtcatggtccccgcgcagtttccaggtgacctggtggctgaggcgcccagtgccaaacccccgccagacagcctgatgtgcagtgggagctcactggtggcctctgcgggcttggagagccacggccggaccccatctccatccccaccctgcagcagctcccccagtccctcaggccgggctggcccgttctccagcagcaggtgcggcgcctctgtccccatcccagtccccacgcaggtgcagaactaccagcgcattgagcgaaacctgcagtcacccacccagttccaaacacctcggtcctctgccatccgcaggtcaggcagcaccagccccctgggctttgcaagggccagcccctcgccccctgcccacgctgagcatggaggcgtcctggccaggaagatgtctctgggtggaggccggccctacacgccatctcctcaagttggaaccatccctgagcggccaggctggagcgggacgccctccccacagggagctgagatgcggggtggcaggtcccctcgtccaggctcctctgcacccgagcactctccccgcacttccgggctgggctgccgcctgcacagcgcccccaacctgtctgacttgcacgtcgtccgccccaagctgcccaaaccccccacggaccccctgggagctgtgttcagcccaccacaggccagccctccccagccgtcccacggcctgcagtcctgccggaacctgcggggctcacccaagctgcccgacttcctgcagcgaaaccccctgccccccatcctgggctcccccaccaaggctgtgccctcctttgacttcccgaagacccccagctcccagaacctgctggccctcctagcccggcagggcgtggtgatgacgccccctcgaaaccggacgctgcccgacctctcggaggtgggacccttccatggtcagccgttgggccctggcctgcggccaggcgaggaccccaagggcccctttggccggtctttcagcaccagccgcctcactgacctgctccttaaggcggcgtttgggacacaagccccggacccgggcagcacggagagcctgcaggagaagcccatggagatcgcaccctcagctggctttggagggagcctgcacccaggagcccgtgctgggggcaccagcagcccctccccggtggtcttcaccgtgggctctcccccgagcgggagcacgcccccccagggcccccgcaccaggatgttctcagcgggccccactggctctgccagctcttctgcccgccacctggtgcctgggccctgcagcgaggccccagcccctgagctccctgctccaggacacggctgcagctttgccgaccccattgctgcgaacctggagggggctgtgaccttcgaggcccccgacctccctgaggagaccctcatggagcaagagcacacggagatcctgcgtggcctgcgcttcacgctgctgttcgtgcagcacgtcctggagatcgcagccctgaagggcagcgccagtgaggcggcggggggccctgagtaccagctgcaggagagtgtggtggccgaccagatcagcctgctgagccgagaatggggcttcgcggaacagctggtgctgtacctgaaggtggccgagctactgtcctccggcctgcaaagtgccatcgaccagatccgggccggcaagctctgcctgtcgtccactgtgaagcaggtggtgcgcaggctgaatgagctgtacaaggccagcgtggtgtcctgccagggcctgagcctgcggctgcagcgcttcttcctggacaagcagcggctcctggaccgcattcacagcatcactgccgagaggctcatcttcagccacgctgtgcagatggtgcagtcggctgccctggacgagatgttccagcaccgtgagggctgcgtcccacgctaccacaaggccctgctgctcctggaggggctgcagcacatgctctcggaccaggccgacatcgagaacgtcaccaagtgcaagctgtgcattgagcggagactctcggcgctgctgactggcatctgtgcctgacctttctggcctggctgggccccccgtcctgccgagccctgcagagtgggctctgtgtgctggctggactcctcgggacaagcccatggcgctgatcgctggtgctgagccctgccctgggccccacggacagtcagcctgccggcctccctgcagctcacggggcagaaccagcacatctggagccacacagcttggggggtgtctcccatcttttacaggtggggatcacagaatttctgcccctccagctgcctggctcagcaggcgtgggtgccaccaccctctagccccagggcagccccggaggacaggcaagggcctgagaccactgccgactcaaagccaaagcgagctcctgcttagggcaggtcagcaggcactgtgcccaggaagagcctgcggcctcggcgtcccccagtctccaggagcctctccctccgagatacccacccagctttgtcaatcacccaagcactttatgcatatagagacagaacctggacctcaccagggactgctgggcagcgattcctggcagtggcctggtgtttgtacatacacatatgcagacacatgccagggccccccaagcccgagcaccggaccacgttgctgcccaggtctggacctcagcgggagaactggctccggggggagtggggccctgcgctagaggcagaggcagttctttgttcaagcgttcctctggggaccggcagcagaggcaccgtgttctctcagccctggatacgtcttgtaatctttcacactttattcctaaaacgtgtcttatttttatgcagctcattttttctttaaaggagaaaacttgtaggtgtttaagaattggttttgggagggcgaggactgggccaggttagaggcagatggcacaggggcgtgtggcgggcgggtgaggctgctttgcacacctgtgttggtggctgtcccctgccgcccctccctgtggcagcagcaggacaggtgtgtgcccagcaccctccctacctgggcctggaagcagatgaggggaatacttcatgcaaagaaaaaagtaacatgtgcaaaagctccccgtccagctttgacagtcagttttgatgtcagctcctcggcagggtaggcctgatgacagccctgtccctccctgcctccgccttgcccaaggccacggagggcgtctgcagagaggcctgccttccggattccaggcgggcatgccctgcaaaccccgcctgggcctcccttggtctgcccagccctcggttagccctgcctgaatcagtagatacttgaacgagtccccagtctgcgggaggcagtggtggggccatggacccatgcggggggttccagggtcacacgccacataacagacaaaaatacacacacgtgtgtttttctttgcaatacttgaaatattgccactgtgcttggacttagaagaagaaaatccccgtgacttcttcctcatcaccttgatggctttattctcaccttgtggggcatgtttgaatttattgcttcatggccgactggaatcctgagtcctgggaagctggcactgcggggatcttgcccggtgtcctggtcctcttgcttccgtcgcggccgcatgtgcgtgtgtccaagcaggtcctgggcgcctcaactgctgcccctggttgaatgttctcttgatagtgctggaccctttgtctattttaaagcgaattttgtgtgatttcctgccctttgcgttatattgtataataccaacgtaaggaaataaacctttggaattgttgaaaaaaaaaaaaaaaaa

SEQ ID NO: 647 - DNA, 2663 bp, Homo sapiens
tgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatcccttgaaaaaaaa

SEQ ID NO: 648 - DNA, 2200 bp, Homo sapiens
cccaagccagagcggcgcggcctggaagaggccagggcccgggggaggcggcggcagcggcggcggctggggcagcccgggcagcccgagccccgcagcctgggcctgtgctcggcgccatgagcggcggcgggccttcgggaggcggccctgggggctcgggcagggcgcggactagctcgttcgcggagcccggcggcggaggcggaggaggcggcggcggccccggaggctcggcctccggcccaggcggcaccggcggcggaaaggcatctgtcggggccatgggtgggggcgtcggggcctcgagctccgggggtggacccggcggcagcggcggaggaggcagcggaggccccggcgcaggcactagcttcccgccgcccggggtgaagctgggccgtgacagcgggaaggtgaccacagtcgtagccactctaggccaaggcccagagcgctcccaagaagtggcttacacggacatcaaagtgattggcaatggctcatttggggtcgtgtaccaggcacggctggcagagaccagggaactagtcgccatcaagaaggttctccaggacaagaggttcaagaaccgagagctgcagatcatgcgtaagctggaccactgcaatattgtgaggctgagatactttttctactccagtggcgagaagaaagacgagctttacctaaatctggtgctggaatatgtgcccgagacagtgtaccgggtggcccgccacttcaccaaggccaagttgaccatccctatcctctatgtcaaggtgtacatgtaccagctcttccgcagcttggcctacatccactcccagggcgtgtgtcaccgcgacatcaagccccagaacctgctggtggaccctgacactgctgtcctcaagctctgcgattttggcagtgcaaagcagttggtccgaggggagcccaatgtctcctacatctgttctcgctactaccgggccccagagctcatctttggagccactgattacacctcatccatcgatgtttggtcagctggctgtgtactggcagagctcctcttgggccagcccatcttccctggggacagtggggtggaccagctggtggagatcatcaaggtgctgggaacaccaacccgggaacaaatccgagagatgaaccccaactacacggagttcaagttccctcagattaaagctcacccctggacaaaggtgttcaaatctcgaacgccgccagaggccatcgcgctctgctctagcctgctggagtacaccccatcctcaaggctctccccactagaggcctgtgcgcacagcttctttgatgaactgcgatgtctgggaacccagctgcctaacaaccgcccacttccccctctcttcaacttcagtgctggtgaactctccatccaaccgtctctcaacgccattctcatccctcctcacttgaggtccccagcgggcactaccaccctcaccccgtcctcacaagctttaactgagactccgaccagctcagactggcagtcgaccgatgccacacctaccctcactaactcctcctgagggccccaccaagcacccttccacttccatctgggagccccaagaggggctgggaaggggggccatagcccatcaagctcctgccctggctgggcccctagactagagggcagaggtaaatgagtccctgtccccacctccagtccctccctcaccagcctcacccctgtggtgggctttttaagaggattttaactggttgtggggagggaagagaaggacagggtgttggggggatgaggacctcctacccccttggccccctcccctcccccagacctccacctcctccagaccccctcccctcctgtgtcccttgtaaatagaaccagcccagcccgtctcctcttcccttccctggcccccgggtgtaaatagattgttataatttttttcttaaagaaaacgtcgattcgcaccgtccaacctggccccgcccctcctacagctgtaactcccctcctgtcctctgcccccaaggtctactccctcctcaccccaccctggagggccaggggagtggagagagctcctgatgtcttagtttccacagtaaggtttgcctgtgtacagacctccgttcaataaattattggcatgaaaacctgaaaaaaaaaaaaaaaaaaaaa

SEQ ID NO: 649 - DNA, 2808 bp, Homo sapiens
gcggcggcggcggcgcagtttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatactcgctgtctgtcaaccagcggttgactttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaaaaaagtgatgtacaacc

SEQ ID NO: 650 - DNA, 3948 bp, Homo sapiens
atggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttatagttgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtga

SEQ ID NO: 651 - DNA, 4887 bp, Homo sapiens
agcggggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaaggacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaatggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctcacccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcagctgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaaaaaaaaaaaaaaaa

SEQ ID NO: 652 - DNA, 3910 bp, Homo sapiens
cagggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgttgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgccgagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgaagagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctgtggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgagggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagtgtgagctttctgcactgccaccggggctcctgtgttgacttctctcctttcacttgacttggattcaaattgagcagatgtgttttcatagcaggttgtagatgagtgtaggacatttcgtaggtgccacaactatttgagaaacaaaacttgagcataggttccttagtctaattttcttctactcacaaaaaatgaattttagatgctatgcagttggtgatgcgacctggccccggagtagaaagtgaaacaccacatctcgagacattctgttaaacacttgcacgcaacgttagcataacctaattctatcatcagccatttgtgtcagggtactttgaaaaatgaaatcaggaattcaggattacttctgtttctttctttgtttcgtgaggggaaaaaatttttgcttttcaggatttaactttaattcactttaggtttgaccaacctaatacttaaaaattccttgtagtgttttggttttagaacaagcattcatcctggaggagacagtacagacagctgattcgcctggcacctttgcattgtgagagtttcagttaggctatgaatcagaatgtagcggatgaaataaaattactaatttttttcaaaggtgagtccagataaacccctaaaagtaggctaagcgaaagaagaatgtgattaatgcgtatgtctgtaagtaatgtggtaattagcctaagtctgtggtaaaccattcatttggatcctctccttcctccaccaaacttaattccctgctgtttactcatccttatttggagaaaaaaaaaatccaaaagaaaattttgtctaatgaggcttgcatggaatctcatttttttttcctcttttgataatgaaaaccttggcaccagcagagatttcttttgcaagttctcggacaccaggatccccacagagaaactggatctaaatgaggctgtagttttagagcttaaaggactgtcatttattataactgatttggttttctgagaatgcattttgcataaaaccgtacctcaaaccttgcctttgcctaggcaaaggcctaattaacggagagagaaagggtcccaggctggtctcccagctccacgaagggatgagcagatgggacaccgtgccacccctgcttttgcctggccactcctctgccctctttcctgtgtcttcaccttctgctctggggaaaaccacctcacagaagccaggaagtggtactgggaaggcctggctgggcccaagatgtgtaccagttaaagtaaataatttgggacttcaaatgaattccaaccctccaaagttgaaatgcagccagcttagggaggcgcatccttggcgctccttctcagaagtaacatggtggaaaggttctaatcgagacagtccacacagggccagctttgtgtgtggcagctgttggctcaagttctccagcctggatgttgctcatcttcattgtgaccctgggtgctccaagaatgcctcttgtcttcatgtgtgtgcacacccccattcaattctgacagcctcattgagtggacccttttatgatccccaaatgcgggacagagaagttaccattaagctgacccaagttggtagctactaactggtgaagctggattcagacacatctgagtgtagatttcaccatccgtttccggcctcttagtacaggaaaagttcaatcaatgtggaaacaaaagagaaaccagaggagcaaatcaagaggggaaggaaagtaggaagggacgaaggtgaggagactaaagccgagagtgtagatagctctgggagtgtagatcagtcagtcagtcatatagccgagatgaacttgggtctaataacccccagctgaaagcttttccggttctgctgccctcacttaaatgaaaactgctgatccgtttatctgtcattctactgtaaaactcttttaataaaaagaatgaacag

SEQ ID NO: 653 - DNA, 4666 bp, Homo sapiens
agggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgctgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgcggagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgagaagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctatggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgaaggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagttgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtataaaacaagagatgtgcaccaatgaaaactatgctgggtcgaattaccttcagcacaatgttaatgttttcgttctcatttatgcctttgtccatttgcacacaacagaaattgtaatgagcttcactatttttgtttctttccttccttttttttcttttttcctttctttcctttttcttgtcttgtttcttgtttttttctcttgtagtttcttttcttaattgtcatttttgcaacaaaaagccaagaaagagctttagtttcttggcaagaataatgtgatattagtaagtaaaggttcttaaaagtctgatgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgc

SEQ ID NO: 654 - DNA, 4667 bp, Homo sapiens
cagggcctgggcacgaccatggtgggacgtcgcccgcggcttcggggaccgctgcggcagcagaggcggctggccaggaacgcgggccgaggctggaccctttgggcagctagcccgtgatctctgccgtcaccgatcgcgattcctaccccctcgccttcccccggcgccgacggccacaccgccggacgatgcgcgcccgcggccgcccgggaggctgagcccagcttcccgctccgccttccccgcgcagctgcccccatggctttgcggggcgccgcgggagcgaccgacaccccggtgtcctcggccgggggagcccccggcggctcagcgtcctcgtcgtccacctcctcgggcggctcggcctcggcgggcgcggggctgtgggccgcgctctatgactacgaggctcgcggcgaggacgagctgagcctgcggcgcggccagctggtggaggtgttgtcgcaggacgccgccgtgtcgggcgacgagggctggtgggcaggccaggtgcagcggcgcctcggcatcttccccgccaactacgtggctccctgccgcccggccgccagccccgcgccgccgccctcgcggcccagctccccggtacacgtcgccttcgagcggctggagctgaaggagctcatcggcgctgggggcttcgggcaggtgtaccgcgccacctggcagggccaggaggtggccgtgaaggcggcgcgccaggacccggagcaggacgcggcggcggctgccgagagcgtgcggcgcgaggctcggctcttcgccatgctgcggcaccccaacatcatcgagctgcgcggcgtgtgcctgcagcagccgcacctctgcctggtgctggagttcgcccgcggcggagcgctcaaccgagcgctggccgctgccaacgccgccccggacccgcgcgcgcccggcccccgccgcgcgcgccgcatccctccgcacgtgctggtcaactgggccgtgcagatagcgcggggcatgctctacctgcatgaggaggccttcgtgcccatcctgcaccgggacctcaagtccagcaacattttgctacttgaagagatagaacatgatgacatctgcaataaaactttgaagattacagattttgggttggcgagggaatggcacaggaccaccaaaatgagcacagcaggcacctatgcctggatggcccccgaagtgatcaagtcttccttgttttctaagggaagcgacatctggagctgtggagtgctgctgtgggaactgctcaccggagaagtcccctatcggggcattgatggcctcgccgtggcttatggggtagcagtcaataaactcactttgcccattccatccacctgccctgagccgtttgccaagctcatgaaagaatgctggcaacaagaccctcatattcgtccatcgtttgccttaattctcgaacagttgactgctattgagggggcagtgatgactgagatgcctcaagaatcttttcattccatgcaagatgactggaaactagaaattcaacaaatgtttgatgagttgagaacaaaggaaaaggagctgcgatcccgggaagaggagctgactcgggcggctctgcagcagaagtctcaggaggagctgctaaagcggcgtgagcagcagctggcagagcgcgagatcgacgtgctggagcgggaacttaacattctgatattccagctaaaccaggagaagcccaaggtaaagaagaggaagggcaagtttaagagaagtcgtttaaagctcaaagatggacatcgaatcagtttaccttcagatttccagcacaagataaccgtgcaggcctctcccaacttggacaaacggcggagcctgaacagcagcagttccagtcccccgagcagccccacaatgatgccccgactccgagccatacagttgacttcagatgaaagcaataaaacttggggaaggaacacagtctttcgacaagaagaatttgaggatgtaaaaaggaattttaagaaaaaaggttgtacctggggaccaaattccattcaaatgaaagatagaacagattgcaaagaaaggataagacctctctccgatggcaacagtccttggtcaactatcttaataaaaaatcagaaaaccatgcccttggcttcattgtttgtggaccagccagggtcctgtgaagagccaaaactttcccctgatggattagaacacagaaaaccaaaacaaataaaattgcctagtcaggcctacattgatctacctcttgggaaagatgctcagagagagaatcctgcagaagctggaagctgggaggaggcagcctctgcgaatgctgccacagtcaccattgagatggctcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgtcatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcggacatgtgggaatgtaccttactgtgcttcttcaaaacatagaccatcacatcacagacggaccatgtctgatggaaatccgaccccaactggtgcaactattatctcagccactggagcctctgcactgccactctgcccctcacctgctcctcacagtcatctgccaagggaggtctcacccaagaagcacagcactgtccacatcgtgcctcagcgtcgccctgcctccctgagaagccgctcagatctgcctcaggcttacccacagacagcagtgtctcagctggcacagactgcctgtgtagtgggtcgcccaggaccacatcccacccaattcctcgctgccaaggagagaactaaatcccatgtgccttcattactggatgttgacgtggaaggtcagagcagggactacactgtgccactgggtagaatgaggagcaaaaccagccggccatctatatatgaactggagaaagaattcctgtcttaaactaagtgccttactgttgtttaagcatttttttaaggtgaacaaatgaacacaatgtgtctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtataaaacaagagatgtgcaccaatgaaaactatgctgggtcgaattaccttcagcacaatgttaatgttttcgttctcatttatgcctttgtccatttgcacacaacagaaattgtaatgagcttcactatttttgtttctttccttccttttttttcttttttcctttctttcctttttcttgtcttgtttcttgtttttttctcttgtagtttcttttcttaattgtcatttttgcaacaaaaagccaagaaagagctttagtttcttggcaagaataatgtgatattagtaagtaaaggttcttaaaagtctgatgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacgttcttcctccatcagtagccctttatttgatattcagaagtggaaagctttttcattctccagtagaacttttaaaaattgttacagatacctagctcttcacagatatcatgtattgtaaacagtcatgtgtcttaattttattttctctatttgagtgcataattatcctaataatcccaaagacactgacaactcaaggaacagcagtacagtactattagaagttaagtatgttgttgttatttcacatttcatttaattgtggataaatgttagacatctgttgaaataagctcatatggtggaaacgacaactatattatgaattattttcagaaatggatctttgaatagcagatcaggatttaaataataaaattatctatgaatcacttttatggtcatacatatatgatacaaatccagagttattggtgcagaaatggctacccgagagcttggtaaatttgc

SEQ ID NO: 655 - DNA, 2670 bp, Homo sapiens
ggttgggatctgaggggtcctctctgtgcccatcacagtttgagcttcagggaaaagaagaagaggtctttgcccttcgtttttccacgggaggagaatcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaaaaaaaaaaaaaaaa

SEQ ID NO: 656 - DNA, 2820 bp, Homo sapiens
gcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagagtgagccatggagctacgtgtggggaacaagtaccgcctgggacggaagatcgggagcgggtccttcggagatatctacctgggtgccaacatcgcctctggtgaggaagtcgccatcaagctggagtgtgtgaagacaaagcacccccagctgcacatcgagagcaagttctacaagatgatgcagggtggcgtggggatcccgtccatcaagtggtgcggagctgagggcgactacaacgtgatggtcatggagctgctggggcctagcctcgaggacctgttcaacttctgttcccgcaaattcagcctcaagacggtgctgctcttggccgaccagatgatcagccgcatcgagtatatccactccaagaacttcatccaccgggacgtcaagcccgacaacttcctcatggggctggggaagaagggcaacctggtctacatcatcgacttcggcctggccaagaagtaccgggacgcccgcacccaccagcacattccctaccgggaaaacaagaacctgaccggcacggcccgctacgcttccatcaacacgcacctgggcattgagcaaagccgtcgagatgacctggagagcctgggctacgtgctcatgtacttcaacctgggctccctgccctggcaggggctcaaagcagccaccaagcgccagaagtatgaacggatcagcgagaagaagatgtcaacgcccatcgaggtcctctgcaaaggctatccctccgaattctcaacatacctcaacttctgccgctccctgcggtttgacgacaagcccgactactcttacctacgtcagctcttccgcaacctcttccaccggcagggcttctcctatgactacgtctttgactggaacatgctgaaattcggtgcagcccggaatcccgaggatgtggaccgggagcggcgagaacacgaacgcgaggagaggatggggcagctacgggggtccgcgacccgagccctgccccctggcccacccacgggggccactgccaaccggctccgcagtgccgccgagcccgtggcttccacgccagcctcccgcatccagccggctggcaatacttctcccagagcgatctcgcgggtcgaccgggagaggaaggtgagtatgaggctgcacaggggtgcgcccgccaacgtctcctcctcagacctcactgggcggcaagaggtctcccggatcccagcctcacagacaagtgtgccatttgaccatctcgggaagtgaggagagcccccattggaccagtgtttgcttagtgtcttcactgtattttctttaaaaaaaaaaaaaaaaaaaaaaaggcaaaaataaaccactcaaaagaacaacaaaaaaacccagcacaaaaccgacgatggagtttgtttctttgatttctttgccaatggcaagaagatgagatgccctcagcactgaggattcttgcccccttgtggtgcccgctgcccccaaccttcaggctgccagatgctcccctgacaacaccaggctacaggagccagacgccagggcctgcccggcctcctgttcctgcccccacccaccacctgcctggagaggaacgggtcgggtccgtgtcggagaagtgacaggtcccagagccaaagccggccctcaagcatcatcagggagtggtgtagtcagttgaaggcagttcccaccgagttttccgagcctcagaatccaggagatacgcacagccccacccactctgagatgacagtggctgacttcccgtgctgggcttttccattgtccccctggcctccaggctcctcctctgcctctccatggagtgggtggggaggtggtgggggccggcgtcccctgcgtgtgtgtgtgtgtgtgtgtgtgtggatgtattgacctgtgtttcccaagacagcaggtgccacggcccgccccgcctgccagcccgaattcccgttctcctgtgtctactaacaaggacatgggggtgggcggtgacctccgcatccctcagagctcagagggtcctcgctgccaccggtccccccctagcccgtcatcagccggtggcagctccatcttccattcctggttttagggcagaatccatggagactgcttccagaaggcatctggctctgagttataaattacttccctggtcctgacagtcacctggggtcccccctctccctggttccacctttctgaggaggagcctggagtcagggctgggttttggattaacccatccttcctagttaacacctttttgtttttattttattttatttttgtttgttttctccgtgtgtgtgttttcctaatttatttacctctgtttcccctttttcctttttttttttaattaaagagcaaagctttttattactttgtaatttaaaaaactgaaaaaaaaaaaactgaagaactttggggggaattttgtacttttttcctgtgtaaatattggacttttttgagctttatcgtggttgttaatttgaagtaataaagtagaaaagataaagtgaaaaaaaaaaaaaaaaaaaaaaaaaaaaa

SEQ ID NO: 657 - DNA, 4913 bp, Homo sapiens
caacaggcacctggctgcagccaggaaggaccgcacgccctttcgcgcaggagagtggaaggagggagctgtttgccagcaccgaggtcttgcggcacaggcaacgcttgacctgagtcttgcagaatgaaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccctcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacaccagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggatgaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctgcttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattccttcccctcagagctcttatgtggattaaacgagataatgtatataaagtactttagcctggtacctagcacacaataagcattcaataaatattagttaatattat

SEQ ID NO: 658 - DNA, 5843 bp, Homo sapiens
ttggttgctggtccacttacaaacacttttcatatttgtatgtctttccaatggttatcctgttttgttcatttcaggcatatggccctgatcagattaactgacatgatgtatatgcaaagccttttgagttcttcagaaaaataaattatcttattcaagactgattgcttataaggaacttattatagctaatatagtaggcacaattttttttttgtaattctcctagatgagtcagaacttagttttgacgtaggtaaaaattttatggtcacaaatctcaggtgtgagaaaatctctttccttgatactctatataaatagaggatataaatatttcaagtctggaagtagtgagagaagctggtaattctggacatatagtgacagtcaaaaaggagctcaggtacaggactggtctaagctgctcaagattcaggagacagccagtacacagagaagctgaggagatacataagatatatctaaaacatttatctaaccttctgtggtaacaagctccttaaaggggctggatgatgttgtgttcactttttatcaccagcaaaggctaagataatgtatatagtaaatatttagtaactatttattaaataaataaatatttaagacagaataaacaagtataataaatgaaccaataagaatgcaccatctaagtcaaaatagccacttttatccttaacattgtacctgctttggctgctgcagaagcaaacttgttggcattagacaaatcaagctggtgatttaataaattccaatgtaagtcttaccagtattgatgaataactatccagcactcaccatgaaagttaaagaaacaacacagaaaaagttcctaagtggtcccaatttgaaatgatcagataacctataaaagaacatattcatattatactaacataaacacatataaatgcacttacagcagttacacagtattctcttcaataactagtttccttatgcattaatgtgtaataacagcaactacaatatttagataattataaaaaccaaggcaataatttaaaaactgattaaccgttttactctaacttaagcatggattggatcagtaagattgattaataaatttgaatgcagtcagttggattgattctaatttaaagttttaatttgttgtagaataattttaagtgaatatatttgtccagtgttcgagtgctcaacagtgtgtttgaaaaggaaaacaaagaaatgtttttgagaaatgtgttaattccttaagacaatggattttaattggatctagttgttttcatttttcttcattatcattatacatctgtatgttggacagaacactaacactaaatagtttttagaaaaattttttaaagttatttaaatcataatatcatgactgacttttaaattcaaaattaggctgtgactatccttcttcacttaggaagagtgttgtgaaagccagaccatctgctgaggtgctacagttacatgtggccctcagaatgcatttggcctgctctgttttagcactctgttggattaccaatacacaaaacaagttaaccttgatctttcacattaagtatctcagggacaaaatttgacatacgtctaaacctgtgacgtttccatctaaagaaggcagaaataaaacaggactttagattcggttacaataaaatatcagatgcaccagagacacaaggcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagttatacatcttcaggatgattcatctagcagacagctctggacagacaaaagttttctctcaatgtgtaacacactgcagtttttcacaatggtggcatcaagcattttataactttttcaccttcagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtgattgatagactacacaagaagtcatatgaagaagggtaaggtaatgaatctctccatctgggaatgattaacacaaatgttggagcatgtttacatacaaacaaagtaggatttacacttaagttatcattcttttagaaactcagtcttcagagcctcaattattaaggaaaagtcttcaggaaaaatactaaaatattttctcttcctcataagcttctaaattaatctctgccttttctgacctcatataacacattatgtaggtttcttatcactttctctttgcataataatgtactaatatttaaaataccttcagcctaaggcacaaggatgccaaaaaaacaaaggtgagaaaccacaacacaggtctaaactcagcatgctttggtgagtttttctccaaaaggggcatattagcaattagagttgtatgctatataatacatagagcacagagccctttgcccataatatcaactttccctcctatagttaaaaagaaaaaaaatgaatctatttttctctttggcttcaaaagcattctgacatttggaggagtcagtaaccaatcccaccaaccactccagcaacctgacaagactatgagtagttctccttcatcctatttatgtggtacaggttgtgaagtatctctatataaagggaaattttagaggggttaggatttggacaggggtttagaacattcctctaagctatctagtctgtggagtttgtggcaattaattgccataaaataacaatgtttccaaatgcaactaagaaaatactcatagtgagtacgctctatgcatagtatgacttctattttaatgtgaagaattttttgtctctctcctgatcttactaaatccatatttcataaataactgagaataattaaaacaaaattaagcaaatgcacaagcaaaaagatgcttgatacacaaaaggaactctggagagaaaactacagcttcagtctgtacagatcaaagaagacagaacatgtcaggggaaggagggaaagatcttgatgcagggtttcttaacctgcagtctatgcacaacactatatttccatgtaatgtttttatttcagccctatttgtattattttgtgcatttaaaaaacacaatcttaaggggatagactagactgccacagcagcccatggcacaactaacacctactgatattcacattaaatagtatggtttccaaaatatgtctgcacaacaagacctctttatgtaattcaggcttgtgtctacctcttccatgaaaaatggaaagggatgaaaataatgggagtataatacccatttaatgtgaaaaacataagagtcttaaaagaaattaagccatttaacattttttaaataggtaagataccattatatttatatgagctatgtactgccacaaaaaaagatgaaatgtaatttctaaatactccaggtgtgtggtattatggaaagcaaattgccaactaatggcacgtcctttctttctttgattttctcctctcatacttcagttttatagtgttgtgttgttgtttttttcatatcctaccttactttccaattctgtctcaattgaactccctctgtctactcactctttcattcatagcttcttttccattaaactcatacctttaattaaccaattcatggcccagttctacagttgaattggacaaggctaaaattctgtagtgtgctaaaatgctcaagttggcacataaacccattccaagattttatagttcttgtagataacacagggatgtagataagttgaaacaaaaccagtgtcctctaagtctctatcatatacttattcctaaactgataattcttacttctggatttaaaatcaaaaataacacacttgtacagatacaatctaagggctttatcacacacgtgttaacgaatgtatctcagcttggttcttcttgtgtgctcattatggatctctctgtcttaggaattgcctcaggcattttttttttttacacattaactaaagggctattcgaaatcttgactcaggggttcttaacctacatttcatgcaaaaaatatatatatttcaatgtattttttattttagtcctatttgtattattttatgcatttaaaaacacagtcctgagagggatggaccagactgccacagcagctcatagcacaaaaaaaggttaagaagtcctagttgactttgtatatatataaagaaatctattacaataaaaatataacataatctattcatctatttatatgcaaacataaaaatgtaaatattgaaacaagattgcttcaatatgcttattgttttcaaaccaacaaactctcttaaggttcaatatgtaataaaaaacataacacaaataattattctatatgaatattatggttcataaattataatgtataatctatacattataatgtaatatataaactaaaatttatggcacaaaagataaatatggctttgaaattaaagatattccactcaacagacaatatttcatatttgatattacaatcatttattttatgtcctattataataaaaggtgaggactccttgtaaaaaaggaaatgttccacagagtcaatctaatatatcagatattggagattctatcttggtttctcttcctttacttagcctataaaactagttaaaaatggaatttcttttagcaattcagtttagtacaggagtgacattaactaatgacaataaattaaacaaagcctacattagttcaatttaagcctattcaacagaaatatagaaatatagtagctaaaaaaatactctggggaaggtaccacaaacattatctaccagggaacatagcataaattagtctgaaatttcctgagagtgactttgtcttagaacttaggtggtagtcatgaagagataatgtttttaggcagttaaaatacttctagaactccatctattttacctgtggtccactttcctacattgaaccaatgccttgggcttctctaattactatacattgtgctcatatgaataaaagaaattttaaaagaaaaaaaa

SEQ ID NO: 659 - DNA, 2272 bp, Homo sapiens
aggcaggagacgtgctgccgggctgggctgcccgggggagatgactcctcgccaggagggcgcctctgggaagaagaccacgggggaagcaaagtttcagggcagctgaggagccttcgccgcagcccttccgagcccaatcatccccctggctatggagggcggactctaagatgaatcccgacctggacaccggccacaacacatcagcacctgcccactggggagagttgaaaaatgccaacttcactggccccaaccagacctcgagcaactccacactgccccagctggacatcaccagggccatctctgtgggcctggtgctgggcgccttcatcctctttgccatcgtgggcaacatcctagtcatcttgtctgtggcctgcaaccggcacctgcggacgcccaccaactacttcattgtcaacctggccatggccgacctgctgttgagcttcaccgtcctgcccttctcagcggccctagaggtgctcggctactgggtgctggggcggatcttctgtgacatctgggcagccgtggatgtcctgtgctgcacagcgtccattctgagcctgtgcgccatctccatcgatcgctacatcggggtgcgctactctctgcagtatcccacgctggtcacccggaggaaggccatcttggcgctgctcagtgtctgggtcttgtccaccgtcatctccatcgggcctctccttgggtggaaggagccggcacccaacgatgacaaggagtgcggggtcaccgaagaacccttctatgccctcttctcctctctgggctccttctacatccctctggcggtcattctagtcatgtactgccgtgtctatatagtggccaagagaaccaccaagaacctagaggcaggagtcatgaaggagatgtccaactccaaggagctgaccctgaggatccattccaagaactttcacgaggacacccttagcagtaccaaggccaagggccacaaccccaggagttccatagctgtcaaactttttaagttctccagggaaaagaaagcagctaagacgttgggcattgtggtcggtatgttcatcttgtgctggctacccttcttcatcgctctaccgcttggctccttgttctccaccctgaagccccccgacgccgtgttcaaggtggtgttctggctgggctacttcaacagctgcctcaaccccatcatctacccatgctccagcaaggagttcaagcgcgctttcgtgcgcatcctcgggtgccagtgccgcggccgcggccgccgccgacgccgccgccgccgtcgcctgggcggctgcgcctacacctaccggccgtggacgcgcggcggctcgctggagcgctcgcagtcgcgcaaggactcgctggacgacagcggcagctgcctgagcggcagccagcggaccctgccctcggcctcgccgagcccgggctacctgggccgcggcgcgccaccgccagtcgagctgtgcgccttccccgagtggaaggcgcccggcgccctcctgagcctgcccgcgcctgagccccccggccgccgcggccgccacgactcgggcccgctcttcaccttcaagctcctgaccgagcccgagagccccgggaccgacggcggcgccagcaacggaggctgcgaggccgcggccgacgtggccaacgggcagccgggcttcaaaagcaacatgcccctggcgcccgggcagttttagggcccccgtgcgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccgagcatgctgagagcctgggggacccgacgccgccgggatttacctctctctctccctctgtgtatatataaacgagtccctctctacttgtatttaaccgtgggtgcacgtgagtgtgactgtgcggtgtgcgtgtgttccgcttgtgtgtgtgcgtggggccgccctgtgagggcgcggcgactgtgcgcccaggaggcaaccgggggcgttgtgtgtgtcgtgacttcgtacctctcaagcccctccttgtacttcactgaaggatggcactttggtggggttggaaacaaagtcgacattaaaggtcatttctcctgaaaaaaaaaaaaaaaaaa

SEQ ID NO: 660 - DNA, 2776 bp, Homo sapiens
ggctcgctgcctcgcattgccacaggctcctgagaggtcgcgggcagtgcctgcggggaggcgcggggccctgctctgtagggctgaaggccgcccgaggttcgccaaggctctgggctctcgaaaggaagccaagaaaagaagctgcccaggtgaccagtcctgggagtgctctctcccaaggaagctccgagcgcccaggagcccttagccggggtctagtgccctttgaacaatctccagctcttcaaggaagtgggctgccgccgcctctcttgggacctggcctgggatcctttccccaaacgcaccccggcgatttttgcgcaccgggagccgaacccctgctgcgcgcagctggctgggctcaggcgcgcttcctcaacgtttcggagccgctgcccccagcgaagtccacattccaagctccaggggctttgagagagacgaccccaaggcaaggcgtttggagagctgctgaggagccaggggcttggaggagcgagaagacatgtattttcagctgagtctcagaaggggagaatctcctgtcaccaccagaaaagcaacagccccgaaatgtgattgcaactgactagcagagcagaggcccaggagtcactggattgatgatttagaatatgctaaaaagccagtgctttatttggggaattcaggggctttctggtgcccaagacagtgacctgcagatgaggactctgaacacctctgccatggacgggactgggctggtggtggagagggacttctctgttcgtatcctcactgcctgtttcctatcgctgctcatcctgtccacgctcctggggaacacgctggtctgtgctgccgttatcaggttccgacacctgcggtccaaggtgaccaacttctttgtcatctccttggctgtgtcagatctcttggtggcagtcctggtcatgccctggaaggcagtggctgagattgctggcttctggccctttgggtccttctgtaacatctgggtggcctttgacatcatgtgctccactgcatccatcctcaacctctgtgtgatcagcgtggacaggtattgggctatctccagccctttccggtatgagagaaagatgacccccaaggcagccttcatcctgatcagtgtggcatggaccttgtctgtactcatctccttcatcccagtgcagctcagctggcacaaggcaaaacccacaagcccctctgatggaaatgccacttccctggctgagaccatagacaactgtgactccagcctcagcaggacatatgccatctcatcctctgtaataagcttttacatccctgtggccatcatgattgtcacctacaccaggatctacaggattgctcagaaacaaatacggcgcattgcggccttggagagggcagcagtccacgccaagaattgccagaccaccacaggtaatggaaagcctgtcgaatgttctcaaccggaaagttcttttaagatgtccttcaaaagagaaactaaagtcctgaagactctgtcggtgatcatgggtgtgtttgtgtgctgttggctacctttcttcatcttgaactgcattttgcccttctgtgggtctggggagacgcagcccttctgcattgattccaacacctttgacgtgtttgtgtggtttgggtgggctaattcatccttgaaccccatcatttatgcctttaatgctgattttcggaaggcattttcaaccctcttaggatgctacagactttgccctgcgacgaataatgccatagagacggtgagtatcaataacaatggggccgcgatgttttccagccatcatgagccacgaggctccatctccaaggagtgcaatctggtttacctgatcccacatgctgtgggctcctctgaggacctgaaaaaggaggaggcagctggcatcgccagacccttggagaagctgtccccagccctatcggtcatattggactatgacactgacgtctctctggagaagatccaacccatcacacaaaacggtcagcacccaacctgaactcgcagatgaatcctgccacacatgctcatcccaaaagctagaggagattgctctggggtttgctattaagaaactaaggtacggtgagactctgaggtgtcaggagagccctctgctgctttccaacacacaattaactccgtttccaaatacattccagtgtattttctgtgttgttcatagtcaatcaaacagggacactacaaacatggggagccataagggacatgtctttggcttcagaattgtttttagaaatttattcttatcttaggatttaccaaatagggcaaagaatcaacagtgaacagcttcacttaaaatcaaatttttctgggaagaaaatgagatgggttgagtttgctgtatacaaacaggtgctaacactgttcccagcaaagttttcagattgtaaaggtaggtgcatgccttcataaattatttctaaaacattaattgaggcttacagtaggagtgagaaatttttttccagaattgagagatgttttgttgatattggttctatttatttattgtatatatggatatttttaatttatgatataataaatatatatttatcatatttaataggataaattaatgagttttatccaagaccttacaaccacatttctggccatttaactagcactttataagccaatgaagcaaacacacagactctgtgagattctaaatgttcatgtgtaacttctaga

SEQ ID NO: 661 - DNA, 1496 bp, Homo sapiens
taaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttaggaagccccttggcatcacgcacctccctctgggctatggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 662 - DNA, 1386 bp, Homo sapiens
taaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttaggaagccccttggcatcacgcacctccctctgggctatggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctcaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 663 - DNA, 1353 bp, Homo sapiens
taaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttaggaagccccttggcatcacgcacctccctctgggctatggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggccctgagtcccaccatagcgcccaagctcagcttagaagttcgaaaactcagcaatggcagattatcgacatctttgaagctggggcccctgcaacctcggggagtgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 664 - DNA, 1398 bp, Homo sapiens
taaagaaaacggatacattcgaaagcagctatgaaacatgcactaaggtctaatagggaagctggaaaagcagcactcaagtaatttcaccttagaggcaaaaatgggtgatttctttctgttcatttcatagtttctgagtcctgagaaaggcaaagtttgctttgcttgggtatgtctgctgtcagtaaatggctgcaggagccgaagtggtaaactcctcggtctccagaaatcagaagaaaattttagggaagccccttggcatcacgcacctccctctgggctatggcatctctgagtcagctgagtagccacctgaactacacctgtggggcagagaactccacaggtgccagccaggcccgcccacatgcctactatgccctctcctactgcgcgctcatcctggccatcgtcttcggcaatggcctggtgtgcatggctgtgctgaaggagcgggccctgcagactaccaccaactacttagtagtgagcctggctgtggcagacttgctggtggccaccttggtgatgccctgggtggtatacctggaggtgacaggtggagtctggaatttcagccgcatttgctgtgatgtttttgtcaccctggatgtcatgatgtgtacagccagcatccttaatctctgtgccatcagcatagacaggtacactgcagtggtcatgcccgttcactaccagcatggcacgggacagagctcctgtcggcgcgtggccctcatgatcacggccgtctgggtactggcctttgctgtgtcctgccctcttctgtttggctttaataccacaggggaccccactgtctgctccatctccaaccctgattttgtcatctactcttcagtggtgtccttctacctgccctttggagtgactgtccttgtctatgccagaatctatgtggtgctgaaacaaaggagacggaaaaggatcctcactcgacagaacagtcagtgcaacagtgtcaggcctggcttcccccaacaaaccctctctcctgacccggcacatctggagctgaagcgttactacagcatctgccaggacactgccttgggtggaccaggcttccaagaaagaggaggagagttgaaaagagaggagaagactcggaattccctgatgccacttcgggagaagaaggcaacccaaatggtggccattgtgcttggggccttcattgtctgctggctgcccttcttcttgacccatgttctcaatacccactgccagacatgccacgtgtccccagagctttacagtgccacgacatggctgggctacgtgaatagcgccctcaaccctgtgatctataccaccttcaatatcgagttccggaaagccttcctcaagatcctgtcttgctgagggagc

SEQ ID NO: 665 - DNA, 1774 bp, Homo sapiens
ccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtacactaagatgaagacggccaccaacatctacatcttcaacctggccttagccgatgcgctggccaccagcacgctgcctttccagagtgccaagtacctgatggagacgtggcccttcggcgagctgctctgcaaggctgtgctctccatcgactactacaatatgttcaccagcatcttcacgctcaccatgatgagtgttgaccgctacatcgctgtctgccaccctgtcaaggccctggacttccgcacgcctgccaaggccaagctgatcaacatctgtatctgggtcctggcctcaggcgttggcgtgcccatcatggtcatggctgtgacccgtccccgggacggggcagtggtgtgcatgctccagttccccagccccagctggtactgggacacggtgaccaagatctgcgtgttcctcttcgccttcgtggtgcccatcctcatcatcaccgtgtgctatggcctcatgctgctgcgcctgcgcagtgtgcgcctgctgtcgggctccaaggagaaggaccgcagcctgcggcgcatcacgcgcatggtgctggtggttgtgggcgccttcgtggtgtgttgggcgcccatccacatcttcgtcatcgtctggacgctggtggacatcgaccggcgcgacccgctggtggtggctgcgctgcacctgtgcatcgcgctgggctacgccaatagcagcctcaaccccgtgctctacgctttcctcgacgagaacttcaagcgctgcttccgccagctctgccgcaagccctgcggccgcccagaccccagcagcttcagccgcgcccgcgaagccacggcccgcgagcgtgtcaccgcctgcaccccgtccgatggtcccggcggtggcgctgccgcctgaccaggccatccggcccccagagcgcccctccctagtgacccggaggccacatgagtcccagtgggaggcgcgagccatgatgtggagtggggcagtagaaggtcggaggcttgggaccgccagatggggcctctgtttcggagacgggaccgggccgctagatgggcatggggtgggcctctggtttggggcgaggcagaggacagatcaatggcgcagtgcctctggtctgggtgccccgtccacggctctaggtggggcgggaaagccagtgactccaggagaggagcgggacctgtggctctacaactgagtccttaaacagggcatctccaggaaggcggggcttcaaccttgagacagcttcggtttctaacttggagccggactttcggagttgggggtccgggccc

SEQ ID NO: 666 - DNA, 1766 bp, Homo sapiens
aattcagagccaccgcgggcaggcgggcagtgcatccagaagcgtttatattctgagcgccagttcagctttcaaaaagagtgctgcccataaaaagccttccaccctcctgtctgctttagaaggaccctgagccccaggcgccagccacaggactctgctgcagaggggggttgtgtacagatagtaggctttacgcctagcttcgaaatggataacgtcctcccggtggactcagacctctccccaaacatctccactaacacctcggaacccaatcagttcgtgcaaccagcctggcaaattgtcctttgggcagctgcctacacggtcattgtggtgacctctgtggtgggcaacgtggtagtgatgtggatcatcttagcccacaaaagaatgaggacagtgacgaactattttctggtgaacctggccttcgcggaggcctccatggctgcattcaatacagtggtgaacttcacctatgctgtccacaacgaatggtactacggcctgttctactgcaagttccacaacttctttcccatcgccgctgtcttcgccagtatctactccatgacggctgtggcctttgataggtacatggccatcatacatcccctccagccccggctgtcagccacagccaccaaagtggtcatctgtgtcatctgggtcctggctctcctgctggccttcccccagggctactactcaaccacagagaccatgcccagcagagtcgtgtgcatgatcgaatggccagagcatccgaacaagatttatgagaaagtgtaccacatctgtgtgactgtgctgatctacttcctccccctgctggtgattggctatgcatacaccgtagtgggaatcacactatgggccagtgagatccccggggactcctctgaccgctaccacgagcaagtctctgccaagcgcaaggtggtcaaaatgatgattgtcgtggtgtgcaccttcgccatctgctggctgcccttccacatcttcttcctcctgccctacatcaacccagatctctacctgaagaagtttatccagcaggtctacctggccatcatgtggctggccatgagctccaccatgtacaaccccatcatctactgctgcctcaatgacaggttccgtctgggcttcaagcatgccttccggtgctgccccttcatcagcgccggcgactatgaggggctggaaatgaaatccacccggtatctccagacccagggcagtgtgtacaaagtcagccgcctggagaccaccatctccacagtggtgggggcccacgaggaggagccagaggacggccccaaggccacaccctcgtccctggacctgacctccaactgctcttcacgaagtgactccaagaccatgacagagagcttcagcttctcctccaatgtgctctcctaggccacagggcctttggcaggtgcagcccccactgcctttgacctgcctcccttcatgcatggaaattcccttcatctggaaccatcagaaacaccctcacactgggacttgcaaaaagggtcagtatgggttagggaaaacattccatccttgagtcaaaaaatctcaattcttccctatctttgccaccctcatgctgtgtgactcaaaccaaatcactgaactttgctgagcctgtaaaataaaaggtcggaccagcttttcctcaagagcccaatgcattccatttctggaagtgactttggctgcatgcgagtgctcatttcaggatg

SEQ ID NO: 667 - DNA, 1983 bp, Homo sapiens
cgagtaaagtttgcaaagaggcgcgggaggcggcagccgcagcgaggaggcggcggggaagaagcgcagtctccgggttgggggcgggggcggggggggcgccaaggagccgggtggggggcggcggccagcatgcggccccgcagcgccctgccccgcctgctgctgccgctgctgctgctgcccgccgccgggccggcccagttccacggggagaagggcatctccatcccggaccacggcttctgccagcccatctccatcccgctgtgcacggacatcgcctacaaccagaccatcatgcccaaccttctgggccacacgaaccaggaggacgcaggcctagaggtgcaccagttctatccgctggtgaaggtgcagtgctcgcccgaactgcgcttcttcctgtgctccatgtacgcacccgtgtgcaccgtgctggaacaggccatcccgccgtgccgctctatctgtgagcgcgcgcgccagggctgcgaagccctcatgaacaagttcggttttcagtggcccgagcgcctgcgctgcgagcacttcccgcgccacggcgccgagcagatctgcgtcggccagaaccactccgaggacggagctcccgcgctactcaccaccgcgccgccgccgggactgcagccgggtgccgggggcaccccgggtggcccgggcggcggcggcgctcccccgcgctacgccacgctggagcaccccttccactgcccgcgcgtcctcaaggtgccatcctatctcagctacaagtttctgggcgagcgtgattgtgctgcgccctgcgaacctgcgcggcccgatggttccatgttcttctcacaggaggagacgcgtttcgcgcgcctctggatcctcacctggtcggtgctgtgctgcgcttccaccttcttcactgtcaccacgtacttggtagacatgcagcgcttccgctacccagagcggcctatcatttttctgtcgggctgctacaccatggtgtcggtggcctacatcgcgggcttcgtgctccaggagcgcgtggtgtgcaacgagcgcttctccgaggacggttaccgcacggtggtgcagggcaccaagaaggagggctgcaccatcctcttcatgatgctctacttcttcagcatggccagctccatctggtgggtcatcctgtcgctcacctggttcctggcagccggcatgaagtggggccacgaggccatcgaggccaactctcagtacttccacctggccgcctgggccgtgccggccgtcaagaccatcaccatcctggccatgggccagatcgacggcgacctgctgagcggcgtgtgcttcgtaggcctcaacagcctggacccgctgcggggcttcgtgctagcgccgctcttcgtgtacctgttcatcggcacgtccttcctcctggccggcttcgtgtcgctcttccgcatccgcaccatcatgaagcacgacggcaccaagaccgaaaagctggagcggctcatggtgcgcatcggcgtcttctccgtgctctacacagtgcccgccaccatcgtcatcgcttgctacttctacgagcaggccttccgcgagcactgggagcgctcgtgggtgagccagcactgcaagagcctggccatcccgtgcccggcgcactacacgccgcgcatgtcgcccgacttcacggtctacatgatcaaatacctcatgacgctcatcgtgggcatcacgtcgggcttctggatctggtcgggcaagacgctgcactcgtggaggaagttctacactcgcctcaccaacagccgacacggtgagaccaccgtgtgagggacgcccccaggccggaaccgcgcggcgctttcctccgcccggggtggggcccctacagactccgtattttatttttttaaataaaaaacgatcgaaaccatttcacttttaggttgctttttaaaagagaactctctgcccaacaccccc

SEQ ID NO: 668 - DNA, 1413 bp, Homo sapiens
gagtatctggatgtcttggattttcttcccattctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacagatacaaggcagttgtgaagccacttgagcgacagccctccaatgccatcctgaagacttgtgtaaaagctggctgcgtctggatcgtgtctatgatatttgctctacctgaggctatattttcaaatgtatacacttttcgagatcccaataaaaatatgacatttgaatcatgtacctcttatcctgtctctaagaagctcttgcaagaaatacattctctgctgtgcttcttagtgttctacattattccactctctattatctctgtctactattccttgattgctaggaccctttacaaaagcaccctgaacatacctactgaggaacaaagccatgcccgtaagcagattgaatcccgaaagagaattgccagaacggtattggtgttggtggctctgtttgccctctgctggttgccaaatcacctcctgtacctctaccattcattcacttctcaaacctatgtagacccctctgccatgcatttcattttcaccattttctctcgggttttggctttcagcaattcttgcgtaaacccctttgctctctactggctgagcaaaagcttccagaagcattttaaagctcagttgttctgttgcaaggcggagcggcctgagcctcctgttgctgacacctctcttaccaccctggctgtgatgggaacggtcccgggcactgggagcatacagatgtctgaaattagtgtgacctcgttcactgggtgtagtgtgaagcaggcagaggacagattctagcttttcaaggaaaaatgctgcttctcctcccagcgtgtgtatccgactctaagctgtgtgcagg

SEQ ID NO: 669 - DNA, 1413 bp, Homo sapiens; identical to SEQ ID NO: 668

SEQ ID NO: 670 - DNA, 1334 bp, Homo sapiens
aatcattagagcctgagtcactctccccaggagacccagacctagaactacccagagcaagaccacagctggtgaacagtccaggagcagacaagatggagacaaattcctctctccccacgaacatctctggagggacacctgctgtatctgctggctatctcttcctggatatcatcacttatctggtatttgcagtcacctttgtcctcggggtcctgggcaacgggcttgtgatctgggtggctggattccggatgacacacacagtcaccaccatcagttacctgaacctggccgtggctgacttctgtttcacctccactttgccattcttcatggtcaggaaggccatgggaggacattggcctttcggctggttcctgtgcaaattcgtctttaccatagtggacatcaacttgttcggaagtgtcttcctgatcgccctcattgctctggaccgctgtgtttgcgtcctgcatccagtctggacccagaaccaccgcaccgtgagcctggccaagaaggtgatcattgggccctgggtgatggctctgctcctcacattgccagttatcattcgtgtgactacagtacctggtaaaacggggacagtagcctgcacttttaacttttcgccctggaccaacgaccctaaagagaggataaatgtggccgttgccatgttgacggtgagaggcatcatccggttcatcattggcttcagcgcacccatgtccatcgttgctgtcagttatgggcttattgccaccaagatccacaagcaaggcttgattaagtccagtcgtcccttacgggtcctctcctttgtcgcagcagccttttttctctgctggtccccatatcaggtggtggcccttatagccacagtcagaatccgtgagttattgcaaggcatgtacaaagaaattggtattgcagtggatgtgacaagtgccctggccttcttcaacagctgcctcaaccccatgctctatgtcttcatgggccaggacttccgggagaggctgatccacgcccttcccgccagtctggagagggccctgaccgaggactcaacccaaaccagtgacacagctaccaattctactttaccttctgcagaggtggagttacaggcaaagtgaggagggagctgggggacactttcgagctcccagctccagcttcgtctcaccttgagttaggctgagccacaggcatttcctgcttattttaggattacccactcatcagaaaaaaaaaaaaaagcctttgtgtcccctgatttggggagaataaacagatatgagtttaaaaaaaaaaaaaaaaaa

SEQ ID NO: 671 - DNA, 2561 bp, Homo sapiens
tacccagcctgtcgctaaactttccgggcgccagcccggctctgagtcgcgcttctcagcggagtgacccagggacggaggacccaggctggctggggactgtctgctcttctcggcgggatccgtggagagtcctttccctggaatccgagccctaaccgtctctccccagccctatccggcgaggagcggagcgctgccagcggaggcagcgccttcccgaagcagtttatctttggacggttttctttaaaggaaaaagcaaccaacaggttgccagccccggcgccacacacgagacgccggagggagaagccccggcccggattcctctgcctgtgtgcgtccctcgcgggctgctggaggcgaggggagggagggggcgatggctcggcctgacccatccgcgccgccctcgctgttgctgctgctcctggcgcagctggtgggccgggcggccgccgcgtccaaggccccggtgtgccaggaaatcacggtgcccatgtgccgcggcatcggctacaacctgacgcacatgcccaaccagttcaaccacgacacgcaggacgaggcgggcctggaggtgcaccagttctggccgctggtggagatccaatgctcgccggacctgcgcttcttcctatgctctatgtacacgcccatctgtctgcccgactaccacaagccgctgccgccctgccgctcggtgtgcgagcgcgccaaggccggctgctcgccgctgatgcgccagtacggcttcgcctggcccgagcgcatgagctgcgaccgcctcccggtgctgggccgcgacgccgaggtcctctgcatggattacaaccgcagcgaggccaccacggcgccccccaggcctttcccagccaagcccacccttccaggcccgccaggggcgccggcctcggggggcgaatgccccgctgggggcccgttcgtgtgcaagtgtcgcgagcccttcgtgcccattctgaaggagtcacacccgctctacaacaaggtgcggacgggccaggtgcccaactgcgcggtaccctgctaccagccgtccttcagtgccgacgagcgcacgttcgccaccttctggataggcctgtggtcggtgctgtgcttcatctccacgtccaccacagtggccaccttcctcatcgacatggaacgcttccgctatcctgagcgccccatcatcttcctgtcagcctgctacctgtgcgtgtcgctgggcttcctggtgcgtctggtcgtgggccatgccagcgtggcctgcagccgcgagcacaaccacatccactacgagaccacgggccctgcactgtgcaccatcgtcttcctcctggtctacttcttcggcatggccagctccatctggtgggtcatcctgtcgctcacctggttcctggccgccggcatgaagtggggcaacgaggccatcgcgggctacgcgcagtacttccacctggctgcgtggctcatccccagcgtcaagtccatcacggcactggcgctgagctccgtggacggggacccagtggccggcatctgctacgtgggcaaccagaacctgaactcgctgcgcggcttcgtgctgggcccgctggtgctctacctgctggtgggcacgctcttcctgctggcgggcttcgtgtcgctcttccgcatccgcagcgtcatcaagcagggcggcaccaagacggacaagctggagaagctcatgatccgcatcggcatcttcacgctgctctacacggtccccgccagcattgtggtggcctgctacctgtacgagcagcactaccgcgagagctgggaggcggcgctcacctgcgcctgcccgggccacgacaccggccagccgcgcgccaagcccgagtactgggtgctcatgctcaagtacttcatgtgcctggtggtgggcatcacgtcgggcgtctggatctggtcgggcaagacggtggagtcgtggcggcgtttcaccagccgctgctgctgccgcccgcggcgcggccacaagagcgggggcgccatggccgcaggggactaccccgaggcgagcgccgcgctcacaggcaggaccgggccgccgggccccgccgccacctaccacaagcaggtgtccctgtcgcacgtgtaggaggctgccgccgagggactcggccggagagctgaggggaggggggcgttttgtttggtagttttgccaaggtcacttccgtttaccttcatggtgctgttgccccctcccgcggcgacttggagagagggaagaggggcgttttcgaggaagaacctgtcccaggtcttctccaaggggcccagctcacgtgtattctattttgcgtttcttactgccttctttatgggaaccctctttttaatttatatgtatttttcttaatttgtaactttgttgcattttggcaacaatttacctttgctttgggggctttacaatcctaaggttggcgttgtaatgaagttccacttggttcaggtttctttgaactgtgtggtctcaattgggaaaatatatttcctatacgtgtgtcttt

SEQ ID NO: 672 - DNA, 3772 bp, Homo sapiens
gggctgaagacaacttggattgcgaggctagggcttggggagtcgtgcatcccgttccgggcctccgcagcccaacatgggccccgggttccaaagtttgcgaagttgggcgccgaggggccggggcgcgcggagcgtccgggggggcccgggcccggattctctgggcgcacaggtcgcctgagccgcctccgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggcctccggaatgccccccgctgctgggcagtgatccagcccctgctgtgtgccgtatacatgcccaagtgtgagaatgaccgggtggagctgcccagccgtaccctctgccaggccacccgaggcccctgtgccatcgtggagagggagcggggctggcctgacttcctgcgctgcactcctgaccgcttccctgaaggctgcacgaatgaggtgcagaacatcaagttcaacagttcaggccagtgcgaagtgcccttggttcggacagacaaccccaagagctggtacgaggacgtggagggctgcggcatccagtgccagaacccgctcttcacagaggctgagcaccaggacatgcacagctacatcgcggccttcggggccgtcacgggcctctgcacgctcttcaccctggccacattcgtggctgactggcggaactcgaatcgctaccctgctgttattctcttctacgtcaatgcgtgcttctttgtgggcagcattggctggctggcccagttcatggatggtgcccgccgagagatcgtctgccgtgcagatggcaccatgaggcttggggagcccacctccaatgagactctgtcctgcgtcatcatctttgtcatcgtgtactacgccctgatggctggtgtggtttggtttgtggtcctcacctatgcctggcacacttccttcaaagccctgggcaccacctaccagcctctctcgggcaagacctcctacttccacctgctcacctggtcactcccctttgtcctcactgtggcaatccttgctgtggcgcaggtggatggggactctgtgagtggcatttgttttgtgggctacaagaactaccgataccgtgcgggcttcgtgctggccccaatcggcctggtgctcatcgtgggaggctacttcctcatccgaggagtcatgactctgttctccatcaagagcaaccaccccgggctgctgagtgagaaggctgccagcaagatcaacgagaccatgctgcgcctgggcatttttggcttcctggcctttggctttgtgctcattaccttcagctgccacttctacgacttcttcaaccaggctgagtgggagcgcagcttccgggactatgtgctatgtcaggccaatgtgaccatcgggctgcccaccaagcagcccatccctgactgtgagatcaagaatcgcccgagccttctggtggagaagatcaacctgtttgccatgtttggaactggcatcgccatgagcacctgggtctggaccaaggccacgctgctcatctggaggcgtacctggtgcaggttgactgggcagagtgacgatgagccaaagcggatcaagaagagcaagatgattgccaaggccttctctaagcggcacgagctcctgcagaacccaggccaggagctgtccttcagcatgcacactgtgtcccacgacgggcccgtggcgggcttggcctttgacctcaatgagccctcagctgatgtctcctctgcctgggcccagcatgtcaccaagatggtggctcggagaggagccatactgccccaggatatttctgtcacccctgtggcaactccagtgcccccagaggaacaagccaacctgtggctggttgaggcagagatctccccagagctgcagaagcgcctgggccggaagaagaagaggaggaagaggaagaaggaggtgtgcccgctggcgccgccccctgagcttcacccccctgcccctgcccccagtaccattcctcgactgcctcagctgccccggcagaaatgcctggtggctgcaggtgcctggggagctggggactcttgccgacagggagcgtggaccctggtctccaacccattctgcccagagcccagtccccctcaggatccatttctgcccagtgcaccggcccccgtggcatgggctcatggccgccgacagggcctggggcctattcactcccgcaccaacctgatggacacagaactcatggatgcagactcggacttctgagcctgcagagcaggacctgggacaggaaagagaggaaccaataccttcaaggctcttcttcctcaccgagcatgcttccctaggatcccgtcttccagagaacctgtgggctgactgccctccgaagagagttctggatgtctggctcaaagcagcaggactgtgggaaagagcctaacatctccatggggaggcctcaccccagggacagggccctggagctcagggtccttgtttctgccctgccagctgcagcctggttggcagcatctgctccatcggggcagggggtatgcagagcttgtggtggggcaggaacggtggaggcagaggtgacagttcccagagtgggctttggtggccagggaggcagcctagcctatgtctggcagatgagggctggctgccgttttctgggctgatgggtgccctttcctggcagtctcagtccaaaagtgttgactgtgtcattagtcctttgtctaagtagggccagggcaccgtattcctctcccaggtgtttgtggggctggaaggacctgctcccacaggggccatgtcctctcttaataggtggcactaccccaaacccatcttttgttctcctatatcctccttctcctgttccatttcagttcagtttcagcggtgccaacctctttgcgtttcctttttgttgatgaggacccagagctgctgcacacactcacctctaaccccctcccctcgctgctgggccccatctccacaggagagactggttcggctctagggcctcagtctggagtgggataggagcagtgagtgacaaagcctctgaaagatgcatcatctcttcctcacacccatttagtgggggatgggtcctctagacttgaggggctaccctgggaagctgccgtagcttcagccaggcaagaaagcttccttcaacctgcatagccggtgggtgaggagattcccaccttccatagcctccaaacatgttcccaaggccccactttcaagaatcagacagcaggaagccatagatgctggctgggttccaggttatggggagaagaaatacagtcaataaaaggtttttgtataaaaaaaaaaaaaaaaaaaaaaaaaaaaaaaaaaaaa

SEQ ID NO: 673 - DNA, 978 bp, Homo sapiens
atgaattcctcatttcacctgcatttcttggatctcaacctgaatgccacagagggcaacctttcaggacccaatgtcaaaaacaagtcttcaccatgtgaagacatgggcattgctgtggaggtgtttctcactctgggtgtcatcagcctcttggagaacatcttggtcataggggccatagtgaagaacaaaaacctgcactcccccatgtacttcttcgtgtgcagcctggcagtggcggacatgctggtgagcatgtccagtgcctgggagaccatcaccatctacctactcaacaacaagcacctagtgatagcagacgcctttgtgcgccacattgacaatgtgtttgactccatgatctgcatttccgtggtggcatccatgtgcagcttactggccattgcagtggataggtacgtcaccatcttctacgccctgcgctaccaccacatcatgacggcgaggcgctcaggggccatcatcgccggcatctgggctttctgcacgggctgcggcattgtcttcatcctgtactcagaatccacctacgtcatcctgtgcctcatctccatgttcttcgctatgctgttcctcctggtgtctctgtacatacacatgttcctcctggcgcggactcacgtcaagcggatcgcggctctgcccggggccagctctgcgcggcagaggaccagcatgcagggcgcggtcaccgtcaccatgctgctgggcgtgtttaccgtgtgctgggccccgttcttccttcatctcactttaatgctttcttgccctcagaacctctactgctctcgcttcatgtctcacttcaatatgtacctcatactcatcatgtgtaattccgtgatggaccctctcatatatgccttccgcagccaagagatgcggaagacctttaaggagattatttgctgccgtggtttcaggatcgcctgcagctttcccagaagggattaa

SEQ ID NO: 674 - DNA, 1558 bp, Homo sapiens
attatgaagggtgtttcggtatcttccctccaaaatgctaagaaataatttaggcaacagttcagactctaaaaatgaagatggctcggtcttttcacagactgaacacaatattgttgcaacttacttgattatggcaggtatgataagtattatcagcaacataatagttctgggcatcttcattaagtacaaggaacttcggacacccacaaatgcaattattattaacctggctgttactgatataggggtcagtagcattggctatcccatgtctgctgcctcagatctgtatggaagttggaaatttggatacgcaggctgtcaggtttatgctggattgaatattttttttggaatggcaagcattggattactcacggtcgtggctgtggaccgatacctgaccatctgccttcctgacgtagggagaagaatgaccaccaacacttacatcggcttgattctgggagcctggatcaatggcctgttttgggctttgatgcctatcatagggtgggctagttatgccccagatcctactggtgctacgtgtaccataaactggaggaaaaatgatagatcttttgtgtcttacaccatgacagttattgcgataaattttattgtgcccttgacagtgatgttttactgctattaccatgtcacgctatccattaaacatcacactaccagtgactgcactgagtccctcaacagagactggtcagatcagatagatgtaacaaagatgtctgtgatcatgatctgcatgtttctggtggcatggtccccttattccatcgtgtgcttatgggcttcttttggtgacccaaagaagattcctccccccatggccatcatagctccactgtttgcaaaatcttctacattctataacccctgcatttatgtggttgctaataaaaagtttcggagggcaatgcttgccatgttcaaatgtcagactcaccaaacaatgcctgtgacaagtattttacccatggatgtatctcaaaacccattggcttctggaagaatctgaaataagataaaaggacacactatcaaaacactttagttttttgacaatgcttttcttttaaatatgagcccatttagatcaagtgcagacatggatcattgtcctatgagagtgtaagctcctcaagcacagctcgtgcttctgtttgtgcactctggctgctgtagtgtatgcttctctgtgtcctgatatatcaacttattgctcatctcctttgatgaattaggcatcagaggttaaggtcccctttctttctccctattatggcatgcattacactgtactgatgacctttaacttgcctggctcctccattagaataaaagcagtcactaatttaatgttagaataaatgaataattctagataattactgaaatgagttgttggatgttcccagttagaatagaaagcattttttgaatttcaacattttaacatttaaatcaattaacttatgttattaaacaaaaataaatgaacattaaacatgattgtttctaaataaaa

SEQ ID NO: 675 - DNA, 4559 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaa

SEQ ID NO: 676 - DNA, 4520 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatcccatggcaaaaaa

SEQ ID NO: 677 - DNA, 3372 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaa

SEQ ID NO: 678 - DNA, 3333 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacaggtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtacggtcctcctggcggggaacggcaggcagctgtgtccagcaaaggagtgcctggagggcagagtctggcagcatcttccccaggggccggggagggcatgttgcatcaccccactgtggacaggagcccatttacagagctgctgaggggccttcgtccctttgttcactggatgcatatttgttgggtccctgctgtgggcagacaccgtgcagcagcgggataagatgggaagcagaatagcaaggtgctcacaccccattggtggactacgcgggacgtccctgcccatgtcgcgctcagcatgcatcctttgcactgtcgataatcagagaaaccatgttttgggttaaaaa

SEQ ID NO: 679 - DNA, 2302 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaaggtgcggcagtggcgttctggtggaccattgggtggccctggaatgtgtaggaaggggtgtcatgaattccttaaaaggactctccaaatagcattagttgttattattaattgtgtgtcacaagaatttaaaacgcatgtgcagctatttaagaaaagtatcccggaagctcacagtgacattacggaagaaccctcaggtcacaagagtctggggtctcctatactctataactttggccacaccgagacaccacctataccaatatttactcatagttctctttaagccaggagcaatgacgtgtgcctatagtcgcagctactagggaagttgaggcaggaggattgcttgagcccaggaatttgagtctagcctggacaacacagcaggactccatctcttaaaaaaaaaattacttcccccactacttttttttgacataaaaaaatgtattttaaaaggaaactgtactacatctagttaatcataggtttgatatgtagttacgtattttttctaatgtgcattaaaacaaatccataattattaaaataaatgttgtttgtgtgcc

SEQ ID NO: 680 - DNA, 3208 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 681 - DNA, 3254 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagagggaacctggactaaaacacgtgttccggtggcagattgaacaagagctttggtaatctctgtgaaatactgcagagggacagatgaccaaagccaccacatttagaactttggctgcctttggaagtccagagctggatctctcagctcccgcccccagaggctcagcactttggacatggctcacaaacagttgttgattgactgcatgaatgcgtgtgcgtgcaagcatgaaccttgtttaaatcaagagcttacataattttaaccagttctgtcttcagctgtacatactcagtaaaatgtttaatgaaggggaagagattagtctcttctgtgtgaccatgttttccctttattcatcctaaaaagttccatgaattcttgatttcctttcagtggccctttcaacaatgtcttttttcccaagagcataactgttctcattttattgctagccatcttgatctgtgttttattgacatctcttttgagctaatcttcatttctaagataagagttgagattttgcaatctgtgttcgatggctcaatctatcctgtgcttgatgctagaaaggaagacagatttaaagcacatgccttctgtgccggctttcaagtttgtcactaaactctcatttctggaaagtgcaattatagagtatcactcccacttccttggaaacagagctgaagaacttggcacactctccaaacagtcaccatacacactgttgtcaaaaagttccatttttaaccccatttgcattaatattgcagtcaatctctttacctccttttctctttcacggggccgtgacagtgacgcctttccccaaaactctcctcgtttgagaaaaaaagaagtatgtatccccacttatctcggggagaaatgcaaccaactgctgctgtgcacatttatgaatcacagtattgtttagtcggttctgtatctccagtagaaagcataacaaaaagatgacctttgtctcacctcatagctaatttttgcaaataaaatactaaacattg

SEQ ID NO: 682 - DNA, 2358 bp, Homo sapiens
tcgcgggccgaggacgcctctggggcggcaccgcgtcccgagagccccagaagtcggcggggaagtttccccggtggggggcgtttcgggcctcccggacggctctcggccccggagcccggtcgcaggagcgcgggcccgggggcgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacgggtacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtgaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttctggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaaggtgatcttgagactcctgttgcaaatcaactgaccacagaagagaggttcgtttccacactctcgattctgttccattggtctgtatatctatcttggagtcagtaccatattgttttgatcactgtagctttgtagtaagttttgaaataagaaagtgcgagtcctccaaaaaaaaaaaaaaaaa

SEQ ID NO: 683 - DNA, 2412 bp, Homo sapiens
aaccactgtgagctgtatgcgattcagaaaccaagaccaaattttgctcactttcattaatcagttgctcagatagaaggaaatgacatctggttctgtcttcttctacatcttaatttttggaaaatatttttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggagacaacaatggatggtctctgcaatttgacaaatattttgccagttactacaaaatgacttcccaatatccttttgaggcagaaacacctgaatgtttggtcggttctgtgccagtgcaatgtctttgccaaggtctggagcttgactgtgatgaaaccaatttacgagctgttccatcggtttcttcaaatgtgactgcaatgtcacttcagtggaacttaataagaaagcttcctcctgattgcttcaagaattatcatgatcttcagaagctgtacctgcaaaacaataagattacatccatctccatctatgctttcagaggactgaatagccttactaaactgtatctcagtcataacagaataaccttcctgaagccgggtgtttttgaagatcttcacagactagaatggctgataattgaagataatcacctcagtcgaatttccccaccaacattttatggactaaattctcttattctcttagtcctgatgaataacgtcctcacccgtttacctgataaacctctctgtcaacacatgccaagactacattggctggaccttgaaggcaaccatatccataatttaagaaatttgacttttatttcctgcagtaatttaactgttttagtgatgaggaaaaacaaaattaatcacttaaatgaaaatacttttgcacctctccagaaactggatgaattggatttaggaagtaataagattgaaaatcttccaccgcttatattcaaggacctgaaggagctgtcacaattgaatctttcctataatccaatccagaaaattcaagcaaaccaatttgattatcttgtcaaactcaagtctctcagcctagaagggattgaaatttcaaatatccaacaaaggatgtttagacctcttatgaatctctctcacatatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgaggga

SEQ ID NO: 684 - DNA, 1250 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcac

SEQ ID NO: 685 - DNA, 1050 bp, Homo sapiens
ctttctgcccacactagacatggcgcttgccagcgtgttggagagaccgctaccggtgaaccagcgcgggtttttcggacttgggggtcgtgcagatctgctggatctaggtccagggagtctcagtgatggtctgagcctggccgcgccaggctggggtgtcccagaagagccaggaatcgaaatgcttcatggaacaaccaccctggccttcaagttccgccatggagtcatagttgcagctgactccagggctacagcgggtgcttacattgcctcccagacggtgaagaaggtgatagagatcaacccatacctgctaggcaccatggctgggggcgcagcggattgcagcttctgggaacggctgttggctcggcaatgtcgaatctatgagcttcgaaataaggaacgcatctctgtagcagctgcctccaaactgcttgccaacatggtgtatcagtacaaaggcatggggctgtccatgggcaccatgatctgtggctgggataagagaggccctggcctctactacgtggacagtgaagggaaccggatttcaggggccaccttctctgtaggttctggctctgtgtatgcatatggggtcatggatcggggctattcctatgacctggaagtggagcaggcctatgatctggcccgtcgagccatctaccaagccacctacagagatgcctactcaggaggtgcagtcaacctctaccacgtgcgggaggatggctggatccgagtctccagtgacaatgtggctgatctacatgagaagtatagtggctctaccccctgaaagagggtggatgcagctgcttgtgtttcttggggtgactgtcattggtaatacggacacagtgacccatcctccatcctatttatagtggaagggccttcaattgtatcagtacttttttttaagctctggcacattgacctctatgtgttaccagtcattaatgagctgctgcagaggtgactatttgttttactttcttggatgttaaacattacactactcactactcaatctca

SEQ ID NO: 686 - DNA, 3119 bp, Homo sapiens
gtgacagaagtagtaggaagtgagctgttcagaggcaggagggtctattctttgccaaaggggggaccagaattccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagatgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccactggaccatgtaactctagtgtccttcctgattcatgcctgatattgggatttttttccagcccttcttgatgccaagggctaattatattacatcccaaagaaacaggcatagaatctgcctcctttgaccttgttcaatcactatgaagcagagtgaaagctgtggtagagtggttaacagatacaagtgtcagtttcttagttctcatttaagcactactggaatttttttttttgatatattagcaagtctgtgatgtactttcactggctctgtttgtacattgagattgtttgtttaacaatgctttctatgttcatatactgtttacctttttccatggactctcctggcaaagaataaaatatatttatttt

SEQ ID NO: 687 - DNA, 2762 bp, Homo sapiens
gtgacagaagtagtaggaagtgagctgttcagaggcaggagggtctattctttgccaaaggggggaccagaattccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatgcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagatgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccactggaccatgtaactctagtgtccttcctgattcatgcctgatattgggatttttttccagcccttcttgatgccaagggctaattatattacatcccaaagaaacaggcatagaatctgcctcctttgaccttgttcaatcactatgaagcagagtgaaagctgtggtagagtggttaacagatacaagtgtcagtttcttagttctcatttaagcactactggaatttttttttttgatatattagcaagtctgtgatgtactttcactggctctgtttgtacattgagattgtttgtttaacaatgctttctatgttcatatactgtttacctttttccatggactctcctggcaaagaataaaatatatttatttt

SEQ ID NO: 688 - DNA, 1047 bp, Homo sapiens
ggagtcaacaccaacagctctgacctgggcagccttcctgagaaaatgcagccattcctcctcctgttggcctttcttctgacccctggggctgggacagaggagatcatcgggggccatgaggccaagccccactcccgcccctacatggcctttgttcagtttctgcaagagaagagtcggaagaggtgtggcggcatcctagtgagaaaggactttgtgctgacagctgctcactgccagggaagctccataaatgtcaccttgggggcccacaatatcaaggaacaggagcggacccagcagtttatccctgtgaaaagacccatcccccatccagcctataatcctaagaacttctccaacgacatcatgctactgcagctggagagaaaggccaagtggaccacagctgtgcggcctctcaggctacctagcagcaaggcccaggtgaagccagggcagctgtgcagtgtggctggctggggttatgtctcaatgagcactttagcaaccacactgcaggaagtgttgctgacagtgcagaaggactgccagtgtgaacgtctcttccatggcaattacagcagagccactgagatttgtgtgggggatccaaagaagacacagaccggtttcaagggggactccggggggcccctcgtgtgtaaggacgtagcccaaggtattctctcctatggaaacaaaaaagggacacctccaggagtctacatcaaggtctcacacttcctgccctggataaagagaacaatgaagcgcctctaacagcaggcatgagactaaccttcctctgggcctgaccatctctgggacagaggcaagaatccccaaggggtgggcagtcagggttgcaggactgtaataaatggatctctggtgtagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 689 - DNA, 5879 bp, Homo sapiens
cgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccctccgttaagatcctggttccatgccgcagtaggacagcaggcccaagtctgcacatcccagtgatgcaccatgccaatagtggataagttgaaggaggccctgaaacccggccgcaaggactcggctgatgatggagaactggggaagcttcttgcctcctctgccaagaaggtccttttacagaaaatcgagttcgagccagccagcaagagcttctcctaccagctggaggccttaaagagcaaatatgtgttgctcaaccccaaaacagagggagctagtcgccacaagagtggagatgacccaccggccaggagacagggcagtgagcacacgtatgagagctgtggtgacggagtcccagccccgcagaaagtgcttttccccacggagcgactgtctctgaggtgggagcgggtcttccgcgtgggcgcaggactccacaaccttggcaacacctgctttctcaatgccaccatccagtgcttgacctacacaccacctctagccaactacctgctctccaaggagcatgctcgcagctgccaccagggaagcttctgcatgctgtgtgtcatgcagaaccacattgtccaggccttcgccaacagcggcaacgccatcaagcccgtctccttcatccgagacctgaaaaagatcgcccgacacttccgctttgggaaccaggaggacgcgcatgagttcctgcggtacaccatcgacgccatgcagaaagcctgcctgaatggctgtgccaagttggatcgtcaaacgcaggctactaccttggtccatcaaatttttggagggtatctcagatcacgcgtgaagtgctccgtgtgcaagagcgtctcggacacctacgacccctacttggacgtcgcgctggagatccggcaagctgcgaatattgtgcgtgctctggaactttttgtgaaagcagatgtcctgagtggagagaatgcctacatgtgtgctaaatgcaagaagaaggttccagccagcaagcgcttcaccatccacagaacatccaacgtcttaaccctttccctcaagcgttttgccaacttcagcggggggaagatcaccaaggatgtaggctatccggaattcctcaacatacgtccgtatatgtcccagaataatggtgatcctgtcatgtatggactctatgctgtcctggtgcactcgggctacagctgccatgccgggcactattactgctacgtgaaggcaagcaatggacagtggtaccagatgaatgattccttggtccattccagcaacgtcaaggtggttctgaaccagcaggcctacgtgctgttctatctgcgaattccaggctctaagaaaagtcccgagggcctcatctccaggacaggctcctcctcccttcccggccgcccgagtgtgattccagatcactccaagaagaacatcggcaatgggattatttcctccccactgactggaaagcgacaagactctgggacgatgaagaagccgcacaccactgaagagattggtgtgcccatatccaggaatggctccaccctgggcctgaagtcccagaacggctgcattcctccaaagctgccctcggggtccccttcccccaaactctcccagacacccacacacatgccaaccatcctagacgaccctggaaagaaggtgaagaagccagctcctccacagcacttttcccccagaactgctcaggggctgcctgggaccagcaactcgaatagcagcagatctgggagccaaaggcagggctcctgggacagcagggatgttgtcctctctacctcacctaagctcctggctacagccactgccaacgggcatgggctgaaggggaacgacgagagcgctggcctcgacaggaggggctccagcagctccagcccagagcactcggccagcagcgactccaccaaggccccccagacccccaggagtggagcggcccatctctgcgattctcaggaaacgaactgttccaccgctggccactccaaaacgccgccaagtggagcagattctaagacggtgaagctgaagtcccctgtcctgagcaacaccaccactgagcctgcaagcaccatgtctcctccaccagccaaaaaactggccctttctgccaagaaggccagcaccctgtggagggcgaccggcaatgacctccgtccacctcccccctcaccatcctccgacctcacccaccccatgaaaacctctcaccccgtcgttgcctccacttggcccgtccatagagccagggctgtgtcacctgctccccaatcatccagccgcctgcaaccccccttcagcccccaccccacattgctgtccagtacccccaagcccccagggacgtcagaaccacggagctgctcctccatctcgacggcgctgcctcaggtcaacgaggaccttgtgtcccttccacaccagttgccagaggccagtgagcccccccggagcccctctgagaagaggaaaaagacctttgtgggagagccgcagaggctgggctcagagacgtgcctcccacagcacatcagggaggccactgcggctccccacgggaagaggaagaggaagaagaagaagcgcccggaggacacagctgccagcgccctgcaggaggggcagacacagagacagcctgggagccccatgtacaggagggagggccaggcacagctgcccgctgtcagacggcaggaagatggcacacagccacaggtgaatggccagcaggtgggatgtgttacggacggccaccacgcgagcagcaggaagcggaggaggaaaggagcagaaggtcttggtgaagaaggcggcctgcaccaggacccacttcggcacagctgctctcccatgggtgatggtgatccagaggccatggaagagtctccaaggaaaaagaaaaaaagaaagcaggagacacagcgggcagtagaagaggatgggcatctcaaatgcccaaggagtgccaagccccaagatgctgttgtccccgagtccagcagctgcgcaccatccgcgaatggctggtgtcctggggaccgcatggggctgagccaggcccctcctgtgtcttggaatggagagcgggagtctgatgtggtccaggaactgctcaaatactcatctgataaagcttacgggagaaaagttctgacctgggatggcaagatgtcggcggtcagtcaggatgctattgaagacagcagacaggcccggactgagaccgtggttgatgactgggacgaagagtttgaccgagggaaggaaaagaaaattaaaaaatttaagagagagaagaggagaaacttcaacgccttccagaaacttcagactcgacggaacttctggtctgtgactcacccagcaaaggctgccagcctcagctatcgccgctgactgtgcccctgtggaaggaggtcggttccgagggggtgggtgtaagggtgaggtgggggtgtgtgtgccgtgtatgtgtgtaggggtgtggtggggtgtggcgtgtgtgtatgatgtatgtgggctgtgtatctggcacatgtgtgttgggtggtgtgtgtggtgtgggcgcgtctgtggtgtgtgtcctagtcacttggagaagggtgtgtgtgggatgcgtgtgtataagggggtgtgtgtgggatgcgtgtgtataagggggtgtgtgtagtgtgtgttgggtgtggggtgtgtacacctggcatctgtggcatgtgttctggtcacttggagaagggcatgtgtggggtgtgtgtgggatgtgggttgtgtgtatatctggcatgtgtcccagtcacttgcagaagggtgacttcttgccagccgcatcgagatgccatgcattgggttcctaggttggactcatacccgagggtggcagtgggaagattcgggtctcgtttctctctgtcaggactaccgtggtttgttctgcagcctcctggagacaaggcgtcccttcccgggagctgtcggtctggatctgagggagctctctgtgtgggctctgctgtgctgggagcctgtcacggtaggagctctcccggtaccagtgtccacagaccgcccaacatagaggctttgaggcttctctagatcggaacctctttggtgacattcccgaccagccctgcaagagaaacgacagtgtgtgtgtgagcagaggtggctgcacacctgctggacatctttgccaggctgtgccttctcatgtttcatagacagtggtctgtgctggcagaggctgctgcccctggttggggctatcaggagagtgggggatggtggccacatgtcctccaggtggtctcccggtgcatagctggtggctctgggcaagccatcccttgcttctcggggctgacgccaccgttgtgtccgagcccgccctcccctgcttcctcagcgggaccccttcatctgttggccttacctgtcctcagaaaggaagaggtgaccccacccagccacctctcccttttatggaactcgagagggtggccctactgtgcaccccttccttgtgagtagctctcaactgtcctggagagcagaggctatttggggtcggaggagccctcgatacctgcgaatacatctgctttccaggctgctgtttattctgagacgactgtgctgtagcttcccttgcagctgcaataacccgcaggtcttcactgaggtggaggctttggggtagaattctccatttattttactacttaatacaaaacatttatttttgaccagtcctgtggcttccattagcaatatgtttcctttcccaaatatgcaaatagtggctttgtttgctcaattttgtgagtgctttggaatttaaatgattgtataactcaagaagattacttttctatgttgctcaagctgtgcctgccaacttgtaacttaataaatacaggaaatcctcagagaaggtgatattttcaggaaaaagacaaatgccctcatagtagtgggaagtgtgaaggtgaccgtgaacatccttcctcatcgggtctgtccccgtcatttcctcccggagtcgtcgcaggtggagatggacaacgtggtgttggacttagacctccttcagtgtggctctgctgggccagaggcatcctgctgtcccgggtggctgcctcgctgtctgcaccccctctccctggggcagctttgcttcctgcccctgtgctcggggcctgggtggttactggcgtgtagatggaattgcttttttaatatgggaagatacatttatttttttccatgtgggtgggtgtctctttttggattttcttctgtttttacgtttctcttcttagaagggtgggagagaatcaagctcctgtggccacctgtgtcccagcagcagtgagtggagctgctcagggtgccctctcctgcggaccagtctctgaatgttcaaagatgagggcctggcttccgtgctctggctttgtaacttatctggaagggaaagcacatgccttcacgggcaggatgatcaagcggtgctgattcacgagagtggaagcctccagagcttggggctttctggctgctcttcattgacctgtgtgttcccagcacacgaacagcgcccctaacggagatttgttcagcgactgaatatacacctgtaaacgagtagcatgtatacattgattttgattacaaatggttctgtattat

SEQ ID NO: 690 - DNA, 1640 bp, Homo sapiens
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaaaaaaaaaaaaaa

SEQ ID NO: 691 - DNA, 2425 bp, Homo sapiens
gggcgctggtggcggcggtggcggaggtggaggtggaggtggaagctgaagctgaagcagagccagaggcggcgcggcggggtgctcggcggcgcggcacgcggcccagaagcgttggaatcctgaattgagacggctgcgcctaaagacagcaggagtggcggggccgccgccgtcgccggagagatgagccgggaagcttgaggccggagacgcccgccttcgggcccgtccgcccggcttccccgctcccgggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagtatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtgtgagcctcgtaccccagaccccaagcccataaatgggaagggagacatgggagtcccttcccaagaaactccagttcctttcctctcttgcctcttcccactcacttccctttggtttttcatatttaaatgtttcaatttctgtatttttttttctttgagagaatacttgttgatttctgatgtgcaggggatggctacagaaaagcccctttcttcctctgtttgcaggggagtgtggccctgtggcctgggtggagcagtcatcctcccccttccccgtgcagggagcaggaaatcagtgctgggggtggtgggcggacaataggatcactgcctgccagatcttcaaacttttatttatatatatatatataaaaatgccacggtcctgctctggtcaataaaggatcctttgttgataaaaaaaaaaaaaaa

SEQ ID NO: 692 - DNA, 3194 bp, Homo sapiens
cgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctgcactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaattttgggtatattactaagtaacaacatatggttgttctaagaattaaaaggaactgacatgtaaaagtgcttagaacaggacctaggccctgtgcaatggctcacacctgtaattccaacactttgggaggcagaggcgggaggattgcttgaggccgagggttcaagactagcctgggcaacatagcgagactgcatctctacaaaaaatttaaaaattatccaggtgtaatggtgtgcacctgtgatcctagctacttgggaggctgaggtgggagaattgctcaagcccaggagtttgaagttgcaatgagctatgatttcaccactgcattctagcctgggcaacagagtgagatcctgactcaaataaataaataagaagagcagttgcctaccacatagtacttattcagtcagtgttagaggatattgtagtattatcaaaagtattggttattgataatattactgttttgtggtaatgctacttctgcacaccccagtttccttcttggttatgcagaaacagtagaacctgtgtaacctcaaggagatattgtatgaatctcactagccgcagcttataataaagccgagaacatttaaaaaaaaaaaaaaaaaa

SEQ ID NO: 693 - DNA, 1907 bp, Homo sapiens
cccaagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatgtctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtgatgaaggagcttctatgcacccttgtgatgacacatactgtggcccttttccagaatctgagccggaagtgaaggctgtagctaacttccttcgaaaacacagaaagcacattagggcttatctctcctttcatgcatatgctcagatgttactgtatccctattcttacaaatatgcaacaattcccaattttagatgtgtggaatctgcagcttataaagctgtgaatgcacttcagtcagtatacggggtacgatacagatatggaccagcctccacaacgttgtatgtgagctctggtagctcaatggattgggcctacaaaaatggaataccttatgcatttgctttcgaactacgtgacactggatattttggatttttactcccagagatgctcatcaaacccacctgtacagaaactatgctggctgtgaaaaatatcacaatgcacctgctaaagaaatgtccctgagacagcccaaggctcaggtcaactgccataggattctgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaattataaaaaaaaaaaaaaaaaaaaaaaaaaaaaaaaaaaaaaaaaaaaa

SEQ ID NO: 694 - DNA, 2012 bp, Homo sapiens
gcggctgtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 695 - DNA, 1164 bp, Homo sapiens
atgagtcaggagttgaccaaagagcagaaagttttttataaaatggtgcaacaattacttaaggctatccagtgcactgtagagtccgaagctttgcataagcttatgcttttaatttggcaggaatgcccttggttacatgatcaaggaacattagatttaaagttatgggagcaggtgcgttgctgcctgaaaagaggattggagcagggccattttgctaatgttaccgttttgaccacctggagttggttacactctgcgttatacccttttgatatgccagactgtgatgagtcacatcacccattttcttcacctgaagggaattcagaagatttaaagggaaagggtacacaggaaccagaacaacaaagaggggctcctcgccccacttcactcccttcagtagggcataaagaagacactctggtgtcaggggtccacaccatctctaaaggaactcgccttgctcagactattcttattccttaccttcaagaaaatggtggggcctcaggattcggccactcaggcatgaaagttttttggagtagtccagtgtcatctcataaaccatacttggaagtaaaaattaatggagttatgtttatgggaattattgacacaagagctgatcaaactattatagctaaaaaacactggccttcagattgggcctcctcttctgccttatgttctatcatgggtgttggagagtatcagcagccattaaaaaacataaatataattagtgattcctcttatgcggtgtgtagtattactcatttagatctcgcacatctgaaaggcactactaatgaacccctactaaccctacttctcacagtgcaggagctcctctgtgcccgtcatcaccccctttatatcacacatattcgctctcattctgggctacctggtccctgtcagaagggaatgtttgagttgatgctctggtacaaccacagatgtggttttcagactctcttgcttttttgtgagctcaagctgatcattcctttttttcatcagaacgcccgcagtcttacacaacagtttcatttaacgcttgctcaagctcgcatgattattaaaacttgtcctgattgccaagggcattctctctcccctttttcattggaacttggtgccaacccatga

SEQ ID NO: 696 - DNA, 2292 bp, Homo sapiens
actgtcctgacggtgcacacactgctgtgtggaggaacagaggagtccagctggccttcacatggcagggatcagagtcaccaaggtggactggcagcggtcgaggaatggcgctgcccaccacacccaggagtacccctgccctgagctggtggttcgcaggggccagtcgttcagcctcacgctggagctgagcagagccctggactgtgaggagatcctcatcttcacggtggagacaggaccccgggcttctgaggccctccacaccaaagctgtgttccagacatcggagctggagcggggtgagggctggacagcagcaagggaggctcagatggagaaaactctgaccgtcagtctcgccagccctcccagtgctgtcattggccgctacctgctgagcatcaggctttcctctcaccgcaaacacagcaaccggaggctgggcgagtttgttctccttttcaacccatggtgtgcagaggacgatgtgtttctggcctcagaggaggagagacaggagtacgtgctcagcgacagcggcatcatcttccgaggcgtggagaagcacatacgagcccagggctggaactacgggcagtttgaggaggacatcctgaacatctgcctctccatcctggatcgaagccccggtcaccaaaacaacccagccaccgacgtgtcctgccgccacaaccccatctacgtcaccagggtcatcagtgccatggtgaacagcaacaacgaccgaggtgtggtgcaaggacagtggcagggcaagtacggcggcggcaccagcccgctgcactggcgcggcagcgtggccattctgcagaagtggctcaagggcaggtacaagccagtcaagtacggccagtgctgggtcttcgccggagtcctgtgcacagtcctcaggtgcttggggatagccacacgggtcgtgtccaacttcaactcagcccacgacacagaccagaacctgagtgtggacaaatacgtggactccttcgggcggaccctggaggacctgacagaagacagcatgtggaatttccatgtctggaatgagagctggtttgcccggcaggacctaggcccctcttacaatggctggcaggttctggatgccaccccccaggaggagagtgaaggtgtgttccggtgcggcccagcctcagtcaccgccatccgcgagggtgatgtgcacctggctcacgatggccccttcgtgtttgcggaggtcaacgccgactacatcacctggctgtggcacgaggatgagagccgggagcgtgtatactcaaacacgaagaagattgggagatgcatcagcaccaaggcggtgggcagtgactcccgcgtggacatcactgacctctacaagtatccggaagggtcccggaaagagaggcaggtgtacagcaaggcggtgaacaggctgttcggcgtggaagcctctggaaggagaatctggatccgcagggctgggggtcgctgtctctggcgtgacgacctcctggagcctgccaccaagcccagcatcgctggcaagttcaaggtgctagagcctcccatgctgggccacgacctgagactggccctgtgcttggccaacctcacctcccgggcccagcgggtgagggtcaacctgagcggtgccaccatcctctatacccgcaagccagtggcagagatcctgcatgaatcccacgccgtgaggctggggccgcaagaagagaagagaatcccaattacaatatcttactctaagtataaagaagacctgacagaggacaagaagatcctgttggctgccatgtgccttgtcaccaaaggagagaagcttctggtggagaaggacattactctagaggacttcatcaccatcaaggttctgggcccagccatggtgggagtggcagttacagtggaagtgacagtagtcaaccccctcatagagagagtgaaggactgtgcgctgatggtggagggcagcggccttctccaggaacagctcagcatcgacgtgcctaccctggagcctcaggagagggcctcagtccagtttgacatcaccccctccaaaagtggcccaaggcagctgcaggtggaccttgtaagccctcacttcccggacatcaagggctttgtgatcgtccatgtggccactgccaagtgatggatcatgagggactgagaggggtggatttggcccctgtcctcctcctgcccattctttgtctcttccacatgggagccaggaggcctcagttaatcctgcctcaacct

SEQ ID NO: 697 - DNA, 747 bp, Homo sapiens
atgcttgctctcattatctttaacaaagagtttgacagtctttctaaaagagtgggagctgaggttgatgtcataggcatgatgatgctgctacaaaatctggggtacaaggtggatgagaaaagaaatctcactgcttcgactaaaaggttttttggccctccattgtttgtcatgaaattacttaagaaatccttaagtacttatttattggctttccaaggtgccatgagggttaatcacatagtccaaaatcagcagtatggtctctttcaggaaatgactacagagttggaggtattttctctgcaccaagagcacaaggcctctggcatttgtgggaagaaatactctgagcaagtcccagatgtattacaactcaatgaaatctttaaaacgttgaatagcaagaactgcccaagtttgaaggacaaacccaaggtgataatcatccaggcctgccatgttgagaaccatggtgtggtgttggtaaaagattcagtaccggcctctgaaaatatatctttaccaactccgggagattttgaggatgatgctattaatcaagtacacatagagaaggattttattgctttctgctcttccacattaggtaacaggtttcttgtacacagaacatctttgtgggttcaactttcatttgagcagccagatgataaagcacagatgcccagcactgaaagagttacttcgacaagacgtttctatctcttcccagtacattaa

SEQ ID NO: 698 - DNA, 2406 bp, Homo sapiens
atgacagcgacagcgtcggccgagtgcttcccctgctccgggtcgtccaggcaccgggtcctccttcagcactcgcagcacgcactgaagaagacgctacggaagtctccgttttccagactcgggggaattaggaaacgcgcccggcgaccctcgggcagtagcaccgggccaggtttgctttcggaaccgctgacgccactcgccgcctttcccgcctgggcctctcgcgggtcgcaggggtggaagcccgacctgggccagggcccggatttcttcctcccggcctctgcgccgccgcccccggtgccaggacgcgctttgctctcgccgagacccagacgcgccgaaagcctcgcgcgggcagttccccgccccacgccccgggctgcgcgttctcccgcgaagcctctgccgagtgcgcgcgacggcgccgccggactcccccggaccgcgctcccgcgcacgcctgaccggagcaccccgcttcacgggggcgttctgcgcgtccttcctccccggtgcgatttccgttctttttcctctcgcggtccccaggagcccaggcacccctcgacgccgctgccggcggaaccgggaaccctccccggggctccctgcgggcccgaagccgccttcccgaggcggcggagttggcgtggagcctgcccgggaagctgggctgcgccggcctggggcgaaggtccaaggggcgcgggggccgggacgcggggctgtggcgacgaccggccctctgcgaacgctcaggccggcgggtccggggccacaggctgggagtggagctggcggccactggggagtagagaggacgcccaggaacaggtgcaccagggtcccggcggctgggccgagggtcgcaagcagaggggaccggcggctgccagcaagtcccaagcagatgcctccggcggggcagccgcattttacagcgcccattccgcgtacatcgagtatccaaaacgaagaagcagcagaaaccacgagaaaaacagtggagtcaaacggcgtggtaacactggcttcaaggactcctcgagcggtttgggatggcttcctgagggtgacaaagaggagctgtgttttcagccaaatatccgaaccaggaccactgcctgccgccacgccccagcgggcacccctgctttgtgcttatctgtggtggctccgctcgcccacctgggtgggaaccccgagaatgactccagacttttccagggactgcatgccaggcccgtaaggacagaactcaatcagcctgaaaaggaagtcagtgactccgactcaacacaggaatgttctgtgattcctaaagaaggatcctccaaaggaaaaacagatgcaaagccttttatcaattgcaaaacagtatacaatgtgtgttattactcacagttgtcttactgtgaccaaacactttataagcctgcggcaagtcagccttactctcaggaagtggacaatatttggggaaggagaagcagcaggatatttcaggacagtagccttgagaaactggtgcgtgtaggctgcgcactcccagggagacgggacgggcctggcgccggagaggagcccgcactctgcacgaagtctcgccgcccgccggctgttttctggcggagggtgcgccccggagggcggcgagcgcgggtggaggcgtcgccggggtcgggccagcaggctctgggatcgggcttgtgggacaccccgacagtgagtcccacttggggagaaactgagggcagctcgggcggtctggcagcggagaagccaggctggcggaggcccccggccggctgcggattccctccggccccggagccgcagcaggaccggccgggaggcgccgcggaggggagccccatcccggtgcggacagtgcccaccgcgccccgcgagcaccggcgacccaccggcctcttccagggccagcgcagctacccgcccaacttcatccggagcgcgctgtcgtccgtcggcctgcgcgaccgtcagggccgcaccacgggggcgggcagcgacggcaggttcttcggcaggacggccgtcgaggtcgtggggccgatggccgcggccaacgggattggacgactgattattggacagaatggcgtcttgtcgacacctgcggtctcctgcattatcaggaagatcaaggcagctggtggaatcattctaacagccagccactgccctggaggaccagggggagagtttggagtgaagtttaatgttgccaatggagagatctttctgcatgtgatgaaaatcaaggcagtacatgaggaatttgagaaggtccagcaacctgtggctctgaccttgactgagctgctctctctgctcccggacccctccaggatgggtccagaggccttctgctaa

SEQ ID NO: 699 - DNA, 1281 bp, Homo sapiens; identical to SEQ ID NO: 637

SEQ ID NO: 700 - DNA, 2094 bp, Homo sapiens; identical to SEQ ID NO: 640

SEQ ID NO: 701 - DNA, 7634 bp, Homo sapiens
acccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcaccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaagagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccacgtggacgtctcagacaaggcaggagatgagatggacctggaaggcatcagcatggacgcccccggctacatgagcgatggggatgttctgagcaagaacatccggaccgatgacattacaagcggatacatgactgatggtggacttggcctctatacccgtcgcctgaaccggctccctgatgggatggctgtggtacgagagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaaggcttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggtctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaacgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgaccgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggcgagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgac

SEQ ID NO: 702 - DNA, 10967 bp, Homo sapiens
aggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaagagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggacgcccccggctacatgagcgatggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactggttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggcgagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcagaaaaa

SEQ ID NO: 703 - DNA, 3829 bp, Homo sapiens
agggtggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaaaattttgattcagctaaagttccatcagatgagtattgccctgcttgtagagagaagggaaagttaaaagccttaaagacttaccgaattagttttcaagaatctatctttttgtgtgaggatctgcagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaagctggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaagatggagattgtaaaaaacttacctcagaaatatttgcagagatagagacctgtctgaatgaagttagagatgaaatttttattagccttcagccccagcttagatgcacattaggtgatatggaaagccctgtgtttgcatttcccctgctcttaaaactagaaacccacattgaaaagctcttcctatattctttttcttgggactttgaatgttcgcagtgtggacaccaatatcaaaacaggcatatgaagagtctggtcacctttacaaatgtcatccctgagtggcacccacttaatgctgcccattttggtccatgtaacaattgcaacagtaaatcacaaataagaaaaatggtattagaaaaagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatcttcaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccaatgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgttttatacactggacttgtgtaattacttgtgtaataaccatgaacaaaatgcaaggtttaacctttggttctgcccatgaagcatgtaatctttcttacacattaaaatcactgaatgtgtaaaaaaaaaaaaaa

SEQ ID NO: 704 - DNA, 2444 bp, Homo sapiens
agtaacagttgattgttacattcagtaacactgaatgtcagtgcagtccaatttacaggctggagcagcagctgcatcctgcatttccccgaagtattacatgattttcactccttgcaaactttaccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 705 - DNA, 864 bp, Homo sapiens
gtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagtaagaatgaaatcctaaaatacctttcttagtgccatacaaggaaagttaagtaaatgtctttacatttcagtaaatgtctttctataacatatattgaggtattaatggtattcataaaatacagcagtctgctgaagtttctttatccctgtcactaattttacctaatttctattatgggactgtttgctttgaaagttggtgtttttggttgatgagaatttacgtctgcaatctagatgcatatttgtagaataaatttggtcctacctatatgtgtgtgtattgtaaaattttaaagttaacttgtcaattgttcacatacccagtaatgaaataaaatggccgtttggatttccttcaaaaaaaaaaaaaaaaaaaaaaaaaaaaa

SEQ ID NO: 706 - DNA, 6980 bp, Homo sapiens
gtattgcactctcagtctcgccatgttgaagtcagaatggcctgtattcactatcttcgagagaacagagagaaatttgaagcgtttatagaaggatcatttgaagaatatttaaagcgtttggaaaatccacaggaatgggtaggacaagtggaaataagtgccctttctcttatgtacaggaaagattttataatttatcgggaaccaaatgtttctccttcacaagtaacagaaaataattttcctgaaaaggtgttactgtgtttttcaaatggaaatcattatgatattgtgtatcccataaagtataaagaaagctctgctatgtgtcagtctctcctttatgaattgctgtatgagaaggtatttaaaactgatgttagtaaaattgtgatggaactagacacgttggaagtagctgatgaagataacagtgaaatatcagattcagaggatgacagttgcaagagtaagactgctgctgctgctgctgatgtgaatggatttaaacctttgtcaggcaatgagctgaagaacaatgggaactctactagcctgcctttgtctagaaaggttcttaagtcactcaatcctgcagtctatagaaatgtggaatatgaaatttggctgaagtctaaacaagctcagcaaaaacgtgattattccattgctgctggcttacaatatgaagttggagacaaatgtcaagttaggttggatcacaatggaaaatttttgaatgcagatgttcaaggaattcattctgagaatggaccagttttggttgaagaactgggaaagaagcacacatcaaagaacctcaaggcacctcccccagaaagctggaacacagtgtcagggaagaagatgaaaaaaccttccacttctggacaaaatttccattctgatgtggattacagagggccaaagaatccaagcaagccaataaaagccccatcagcactacctcctcgactgcagcatccttcaggagtaagacaacatgcgttctctagtcattcttcagggtcacagtctcagaaattctccagtgagcacaaaaatcttagccggacaccttcacagatcataagaaaacctgatcgtgaaagagttgaggattttgatcacacaagtcgagaatctaactatttcggcctttccccagaagagcgcagagagaagcaagctatagaagaatcccgtttactctatgagattcagaacagagatgaacaggctttcccagccctttccagctcatcagtcaatcagtcagcttctcagagtagcaatccatgtgtccagagaaaatcatcacatgtaggtgatagaaaaggaagcaggcggagaatggatacagaagaacgaaaagacaaagactctattcatggacatagtcagttggataaaagacccgaaccaagcacattggagaatattactgatgataaatatgcaacagtttcatcaccatcaaagtcaaagaagttagagtgcccttctcctgcggaacaaaagccagcagaacatgtgtctttgtcaaatccagctccccttctagtttctccagaggtacatctaactcctgcggtgccttctttaccagccactgtgccagcctggccaagtgaacctacaacttttggaccaacaggtgtccctgctccaattcccgttttgtcagtgacacagactttgaccactggacctgattcagctgtatcccaagctcatttaacaccctctccagttcctgtgtcaatacaggcagttaaccagcccttgatgcctttgcctcagacattgagcctttatcaagacccactctatcctgggtttccttgtaatgaaaagggagatcgagccattgtaccaccttattcactgtgtcagactggggaggacctacctaaagataagaatattcttcgattcttcttcaatcttggtgtgaaggcatacagttgtcctatgtgggccccacattcttacctgtaccctctgcaccaggcctacctggcagcctgcaggatgtacccaaaggtccctgtccctgtttatcctcataatccctggttccaagaggctcctgctgctcagaatgaaagtgattgtacctgtactgatgcccactttcctatgcagactgaggccagtgttaatggtcaaatgccacagccagagattggaccgccgacattttcttcacctctggttatccctccatctcaggtgtctgaaagtcatggacaattgtcttaccaggctgatcttgaatctgagacccctgggcagcttctgcatgctgattatgaagagtcactaagtggcaagaatatgttcccccagccatcttttggacccaatccattcttaggcccagttcctattgcacctcctttctttcctcatgtttggtatgggtacccttttcagggattcatagaaaatccagtaatgaggcagaatattgtcctgccctctgatgaaaaaggagaattggatctgtctctggaaaatctggatctgtctaaagattgtggttcagtttcaacagtagatgagtttccagaagccaggggtgaacatgtacattctctccctgaagcaagtgtgagcagtaagccggacgaaggccggacagagcaatcttcccagacacgaaaggcagatacggcattggcttccatccctcctgtagcagagggaaaggctcatcctcccactcagattctaaacagagagagagaaactgtgcctgttgaacttgaacctaaaaggaccattcaaagcctgaaagaaaaaacagaaaaagtaaaagatcctaagactgctgctgatgtggtcagccctggggccaactctgttgatagcagagtgcaaagaccaaaagaagagagttcagaagatgaaaatgaagtgtctaatattttgagaagtggtagatccaagcagttctataatcaaacttatggaagcaggaagtacaaaagtgattggggctattctggtaggggtggatatcaacatgtgagaagtgaggagtcctggaaaggacagccaagcagaagtcgggatgaaggttatcagtaccatcgaaatgtcagagggcgaccatttaggggagataggaggagatcagggatgggagatggccataggggacagcacacttgatggttgttgccgaagtattttctaacagaaactcttaggtggaatgtttctgaaggctttaaaaaaaatacaataaagtaaaaaccgcagttggaactctttcctctccccagccccccttaccttcactcccatactggacaagacattttggacatgagttcaagggggcaggttaattcctggcattgccagttttcttcattcagaatctgtttgttgatcaagtgactgtccccgtaaaaagtagaagataagtttgttaaagtattttttataaacagcttaatataaaacattatagatttagtgtttggcttttttccttataagtttataagtttgatttcagatgttggaaatgtgtgctttatagtgtttactaaagtgacaagaaaatataccatttgacacactatagattccaaacataacgttgcaccaaatagaaatgtatattttattatgcaatgccttagtcataaactgggctcaaacaattctcagcctaaaacactgttgtcttttaaaatgcttccaacccaaaggcctttcatctcaatatctgtcaaacttgaataatgtcttctctttaatattcacataaggcagcctattaactgtgtcttagcaatgttgtatatagttcttttaatattcataaggtatatttttgaattttggtatttgttgagattgcatagaagaatagtaggaaatccaatgaaatggctgtttccaccaagaattcttagcactggtgtaaatatcatggtgcctactcgaaagaaatgtagatgctatgcattttgaaaataatctgcatcagttagaactgcagaagtttttttaatgccactttaacactaatgcactgacagattctaaatattttgtgagaagaaatgttaaaaatttttagcttgacaggtttctagagttgttttcttcctcccccccccccccgcaccattggttgtgtatcactttcactttacacttgcatgttctacttgtcagggctggaactattgtatagaagataatatgattgtgacttctagttcttttctagaggatgctgctagaaaatggttttgctttgtattttatagcttgttacccttaggtaggtaacatcttacattctgttttcttccagtctttgcagtattcactagaggttccctttgcatgttgcactctgttctcatttggagattgaactctgaattaacacagtattcattcatctgtgttattttgtaaaaataactgtagcttatattctttatttgtgcataccaatgtgaaaatccactcttttattatgttgagattatcttctgatcaggaagtttgagtgctatgcaaataacatagtagtaatttctctttgcatgccatgtgtaatatacctagccaaaaccagatgcggtgactttctttttttgtaaagcaaattacttaagaaaatacaattcacttgaatttgacaaactgaaacagatgggttttctgggttctctgataacctatgggaatgtttggatgccagttgggctagtgaatcgccactgtactgtaataatggttatttacctctgtgctgttttaattacctaacgtctgtgtaactgctgatttgagtagtgattagcatttagataatgtaacaggattttagagagcactttgaaagataacattttattatgatggtgctaggtaaaaaattgtaaagactgggatggttgtgtggaaaacttttcttgagagaacctattgaaaggaatttgttgtcaccttcttaactagaatagttgttgaaggtaccgcttaagccatttttttcttaacatcggtggctcagttaaggaatgagaagatagagggtcctccactttcagctcatgcttttttatgtaggactagcttacctgattttaatgaaaatcacattttgatacaaacaccagatttgaaagttcaatgtgtttgatctcaggagtccaaaataagttgttgcttctagtgtcctgcattttattgactggggtttgatctcagcttctgaaaatgtttaaaaattggaaggaaatactactcatatcttcattgtcactttgtcttacctcaattgagtaacagaatatagctcctgaaggaaacactgatttgctttctgtttcccatatctcacctctaggatatgatggaagaagtgcttgaaagagaattttagcagatggtacttttctcagtgacctctggaataaaagaactgacttttgatagttttaaaattaatctttgcatgaaggttggtttcgctttttttcctttaagtttgtttttaaatgtattagtccaggggattttgccttatgctgaggtcaaactaaggataagcaagcttttgtccttcattttaactgttatgtcatactgttatgttgacatatttctttataagagaatagaggcaaaagtatagaactgaggatcatttgtatttttgagttggaaattatgaaacttcaccatattatgatcatacatattttgaagaacagactgaccaaagctcacctgttttttgtgttaggtgctttggctgaacttgattccagcccccttttccctttggtgttgtgtatgtctcttcatttcctctcaaatcttcaactcttgccccatgtctccttggcagcaggatgctggcatctgtgtagtcctcatactgtttactgataacccacaaattcattttcatggcagacctaagctcagaccctgccttgtcctggcaagcataggttttcccagaccacaatgctgatatatcttatttaatgcagactgtattcttgcagcgtgttgtttcctttgtgactcaaggttgaattaaaatgcctgtgaactgcaaacttgcttatgattgacttggtgcaataaagttcctttctaaccatttctggtttagaaaacattcagccatcctagaaactagcaatatttatttttgcctctttcgttttaccttcatttttagatgaggtaaatgttttgtcttttacttaagggtactaagcaaggtccactctagtgtagctgaagagaatgcatatttggctacactatttctgtttactgtattttgcttcctactttatgtctaaatgctattgtttgtttaaaatcctaataatgtctcatttccaatatgttattttcagataactaaggttttgctactaatgtcagccatttactctcccactaattgggattattttttaaaagaggtctttctccccgaaatacaagttttagaaaatcttagaagaggggtgggtgcatgtcttaatgctgggaagcggcaactttggggttgaacttacttgaatggattaaaaattgcattgtgttacagagctagaaaattttatgtatgaaaaacgataatagccttacactgagtacaaataatactttaagagcatgtgaagatgtgatcatttgtgatgttacttgtaaaaaaaagtatatatacatatcttttgaagtgttaaaaggaaactagtactttatattctttatcatatcactttttgtaagtgttgaatatattcctgtttatttttctatgttctgttttgtagccttaagaagtgtttcaaacatatctgaatgtataaaataagagtaaatgccctacatggtgtgatgctgcattatatataaaactgtgtgcatatattaaattttgtctcttgaaaaaaaaaaaaaaaaaa

SEQ ID NO: 707 - DNA, 7660 bp, Homo sapiens
atgaggcctgggcccgctctcctccttctgggcgtgggcctgagcctgagcgtcggccgcctcccgctgccgccggttcctcgcggggcacaagccgccgtctccggggcgcccggtggcctcctcaggggcgccccgggcctcggggtgcgcggcggccgcgccctcctcagtctgcggcccagcgcggtgcgggcgggcggcgctgtcctgagcggccgcggcagcctctgcttcccccatggcgggaccgggcggcgctggtactgcctcgacttgcgcgtcctgctcagcgcccaacgcctgccctggccggccgcgcccgcgctcgcgctcgtcgacctgcagctctccgcgcgcggcggccgcctctccctgacgtggtccgtgcggctgccgcgctcgcccgggcgcctggcctgggccttccgcctgcggctgctcggacccggcgccgcccgcccggcctcccccgcggcccgcgtctccccgcgctccgccgcgccaggcccgcggccccagcagggcttcgtggcccgcaccgagtgccccacagacggccccgcgcgcgtgatgttgcaggccgtcaactcgtccagccacagagccgtcgagtcgtccgtgtcctgtcagataaacgcctgcgtcatccagcgcgtgaggatcaacacggaccagaagggcgcccccgtgcgcctgagcatgcaggcggaggccaccatcaacgcctcggtgcagctggactgcccggccgcgcgcgccatcgcccagtactggcaggtgttctccgtgcccgccgtgggtcaggcgcccgactggacgcagcccttggatctgccccagctcgagatcaggaacagccccttgttcattcacatccccaataattcgttacagtggggagtgtatgtgtttaatttcacggtgtccatcaccacagggaaccccaagatgcccgaggtgaaagactcggacgccgtctatgtctggatcgtcaggagttccctgcaggcggtgatgcttggcgatgccaacataacagctaatttcacagagcagctgattctggacgggtccacgtcctcggacccagatgcggacagcccgttacagggactccagttcttttggtactgtaccacagatcccagaaactacggtggggatcgaataatcctggggagcaaggaagtctgtcaccccgagcaggccaatctgaaatggccctgggcctcgggccctgtactgacacttttgccagaaacacttaaaggcgaccacgtgtatttcttcagaatggtgattcggaaggactctaggacagcgttttctgataagagggtccacgtgctccaaggaccaaaagccatagcacacatcacatgtatcgaaaattgtgagagaaacttcattgtctctgatagattttctttgttcctaaattgcacaaattgtgcaagccgtgatttctataaatggtcaattttgtcttcttcaggtggtgagatgctatttgattggatgggggaaactgtaacaggaaggaatggtgcttatctgtctataaaagcttttgcttttcggcattttttggaagctgagttttcgatttctctgtatctagcatgttggagtggagtgacctcggtcttcaggcattcttttattattaaccatggccctcagatcggagaatgcaaaattaatccagctaaaggaattgcacttattactaaatttgttgtccagtgtagtaattttagggataagcacgtccctcttacatataaaataattgtttctgatttgcacagtgttggtgaaatcagttcagtaaaagagaacaccctggggaccatcctgtacttggggcctcagtccacagtacccccttcctttctccctgttggtatgttggctagtcaatatggcttgaagatatatgcccaggtctatgattctctaggagctttttctcaggtgactttgcatgccaccgcacaggctcccactgacaaaaattcatcaaagacagtgttgaatcagttactcagtttcaccgtgggaccaagttcattgctgtctactttgattcaaaagaaggattttttacctgcaggttacttactgtatatagtagcttccgttttgaataacatgaaaactgaattacctctccgagatgacagagtcaatctccgaaaacacctcatcgatcagtctttccttcttcctgtaagcactttggtagaaattggccaggtagtcatgactattaccaaattaacccagaaaccctctgaattcacttgggatgctcagaaacgtgccaccatgagggtatggcaagcaaatcaagccctacaagagtatcagcaaaaagataaacgctttcgatctgaacaaatagaaatcgtgagtactggaatactaatgagtttgtctaatattcttaaaatgacttctcctcaccaagtagttaaagatcctttctatgtaatagaatctctatcagacacaatactggctaataaagtgccagggaacaaaaccacctcaatgagaacccccaatttcaacatgtatgtcaagaaagttgaaaagtggggtatcaaccagctcttcagaaatgagaaacactgcagaaattgtttttatccaacactcaatgtgagcagtgttcctggtctgtctgcaaatggtcccatttctacaatgttttgtgatttcacaaatgacctctttccttggttaaatgatcaggaaaacacttcggtggaggtgtctggattcagaatgacaggagttgcagataacggtagtgtgctagagatcacacctgatgtagcggaagtgtaccttgtcaggaaaaacttgacctttgcagcttttaatctcacagtgggacccaacagcgaggttgatgggtccttgaagaagacgacaggtgggtttagctttcaagtggacagcacagtgcttagggaggttctggtccacatagtaacagaagtgatggtgctgttcacagtgttggtgtacacaggcagtcagatcactcccacagcgctggtcgccaccttcctggtgcctcatgacatccctccatttgccagccagagtgccctgtttgacccagcctgcacagtgaagaaggcccgtgtagtctgcctccctgtgtccctgctgcaactcatagctcagcacagccactctccccactgtactgtatccatagttctgcaggcacctcgttttgtcatgaagctcaatgacaagctagtgagaatttctattttcagcgtccagtgcttggacatgtatgggatccagagtgaatggagagagggttattgcattcttggtgagaagaccagctggtatgaggtgcactgcatctgcaagaatgtagtaagggctaggcggcagctgggcacaatcggactcacgggcattcacctgcatacccactatgtgatggccaaggtgattgtgatccctaatcctgtggatctacggttaaacatcatcaagagccttcaccaaaaccccgtgaccctcttcactgtgcttttcattattctcttatacgtgggcctagctttttgggctttatacagggatgaaatggaccagcatcttcgggggcatgtgatagttctaccagataatgatccttatgataatttatgctacttggtgactatttttacaggaagtcgttgggggtctgggaccagggccaatgtctttgtgcaacttagaggaactgtgagtaccagcgacgtgcattgtttaagccatccacatttcacaactctctaccgaggtagcatcaacactttcctcctaacgacaaaaagtgacttgggggacatccattccatccgtgtgtggcacaacaacgagggtcgatcgcctagctggtatttaagtagaatcaaagtggaaaatctgtttagcaggcacatttggctgttcatatgccagaaatggctttctgttgataccactttggacagaacatttcacgttacccatccagatgagcgtctgactagaaaagactttttctttatagatgtgagtagtaatctccggaaaaaccacatgtggttctctatttttgctagtgttgttgctaaaacattcaataggctccagagattgtcctgttgtttagcaatgttgcttagctctcttctttgtaacattatgttctttaatctaaatagacaagaacaaactgagtcaagagagaggaaatacatgagatcaatgatgataggaattgaaagtgtcttaattacaatccctgtgcaattattaataacttttttgttcacctgttcccagaggaaacctcaagcggatctaaaggaggtatctcctcaaaagcatcctctaatgtcagaagcaagtgagcactgggaagaatacttgagaaagtggcatgcttacgaaactgctaaggtgcaccccagggaggttgcaaaacctgcatctaaaggaaagcccaggcttccaaaggcttctcctaaggcaacctccaaacccaagcacaggcataggaaagcacaaatcaagaccccggagaccctcgggccaaatacaaattccaataacaacatagaagatgatcaggatgtccattccgaacagcacccttcccaaaaggatctccagcagcttaagaaaaagccccggatcgtcctaccttggtggtgtgtttatgttgcatggtttttggtttttgctacttctagcatatcctcattcttcattgtattttatggactgacttacggctatgacaagtcaatagaatggctctttgcatctttttgttcattctgtcagtcagttcttctggtgcagccatctaaaattatactcctgtcaggcttcagaacgaataaacccaagtattgcaaaaacctttcatggtcaaccaagtataaatatactgagatcaggttggatggaatgcgtatgcatccagaagaaatgcagaggatacatgaccagatcgtccgaatccgaggcacgaggatgtaccaaccccttacagaagatgaaatcagaatattcaaaagaaagaagaggatcaagagaagagcactcctgtttctgagttacattctaactcactttatctttctagcccttctgttgatccttatcgtcttactacgtcacactgactgcttttactataaccagtttattcgtgatcggttctctatggatcttgctactgtgactaagctggaagacatctatagatggctaaacagcgtgctgttgcctttgttacacaatgacctgaatccaacatttcttcctgaaagctcgtctaaaatccttggccttccattgatgaggcaagtgagagcaaaatctagtgaaaaaatgtgtctacctgccgaaaagtttgtgcaaaacagcatcagaagagaaattcattgtcaccccaaatatggcattgacccagaagacacaaaaaactattctggcttttggaatgaagttgataagcaggctatagatgagagtaccaatggatttacttataagcctcaaggaacgcaatggctatattattcctatggactactacacacctatggatctggaggatatgcactctatttttttccagaacagcagcggtttaattccacactgaggctcaaagaacttcaagaaagcaattggctggatgagaagacatgggctgtggttttggaattaacaacttttaatccagatataaatctgttctgtagcatttcggtcatatttgaagtctctcagttaggagttgtcaacacaagcatatctctgcactctttttcacttgctgattttgacagaaaagcttcagcagaaatctacttgtatgtggccattctcatttttttcttagcctacgttgttgatgagggttgtatcattatgcaagaaagagcctcctatgtgagaagtgtgtataatttgctcaactttgctttaaagtgcatatttactgtgttgattgtgctctttctcaggaaacatttcctggccactggcataattcggttttacttgtcgaacccagaagacttcattccctttcatgcagtttctcaggtagatcacattatgaggataattttgggtttcctgttatttctgacaattttgaagaccctcaggtattccagattcttctacgatgtgcgcctggctcagagggccatccaggctgccctccctggcatctgccacatggcatttgttgtgtccgtgtatttcttcgtatacatggcttttggttacctggtgtttggtcagcatgaatggaactacagtaacttgattcattccactcagacagtattttcctattgtgtctcagctttccagaacactgaattttccaataacaggattctgggggtcctgttcctctcatctttcatgctggtgatgatctgcgtcttgatcaacttatttcaggctgtaattctgtctgcatatgaggaaatgaagcagcccgtgtatgaggagccatcggatgaagtggaagcaatgacctatttgtgccgtaagctgagaaccatgttcagctttctgacctcgcaatctaaggccaaagatgagcctgagttctttattgacatgctgtatgggcagccagagaagaacagccaccgttatctggggctgaagaccagaaacatcaacgggaagaaaatggtttaccttgttgtttgatgaatgatggtttcatgagtcacaagcaagcgttcccccaactgctgagtctgtgggattaaggggattagggagtgtcagtggcctagtcatgctttctactcatgtccttcacaaggcacatcccctacatttggaagaatccccaatcttgtcctctgctcttgggagtgtaaaagttgggagtgtagtgtagcatctggggagacagcaggatcacagtgtgggattcctggactgatttccctttagaggggagttatgtgactccccgtacaagggcaaccctgtttctttggtgcctgcagtttagagaaggcagagccactggttttgagaaccagatttgagagagggacctggccagggtggagcattgtctgggtgtttctgcgcttgacccatgctggaagctaatggcctgttgctcctgacagagccccaaactcctcggcctcactgggaggcccctttgtagaccagggctcccctcctcttgttccccctgggcttagggcctcgtggggagttccaggacttgcttcatgcttgagaatgcagatgtggtgcttctcatttattcttaaagctactggtagttaaagtaaaattcagtaacattttctgaccaagagacatgttttgttaaacaacaaaaaggtacatatgggttcacattgaaatatgtctatatgctgaatatagcaacatatgcatctaagatttgggcatttggttattaatagcgtgctggactattcaggaataaggaaaatgtggtttatcacttaagagaaacaagggctggtagctgtactattttcactcagaagcatgttcatttatgtagatgccactttaagctttatcagaattaaatgtgagatttcttctttga

SEQ ID NO: 708 - DNA, 3318 bp, Homo sapiens
gtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaa

SEQ ID NO: 709 - DNA, 2871 bp, Homo sapiens
atgccccgcgtctcggcgcctttggtgctgcttcctgcgtggctcgtgatggtcgcctgcagcccgcactccttgaggatcgctgctatcttggacgaccccatggagtgcagcagaggggagcggctctccatcaccctggccaagaaccgcatcaaccgcgctcctgagaggctgggcaaggccaaggtcgaagtggacatctttgagcttctcagagacagcgagtacgagactgcagaaaccatgtgtcagatcctccccaagggggtggtcgctgtcctcggaccatcgtccagcccagcctccagctccatcatcagcaacatctgtggagagaaggaggtccctcacttcaaagtggccccagaggagttcgtcaagttccagttccagagattcacaaccctgaacctccaccccagcaacactgacatcagcgtggctgtagctgggatcctgaacttcttcaactgcaccaccgcctgcctcatctgtgccaaagcagaatgccttttaaacctagagaagctgctccggcaattccttatctccaaggacacgctgtccgtccgcatgctggatgacacccgggaccccaccccgctcctcaaggagatccgggacgacaagaccgccaccatcatcatccacgccaacgcctccatgtcccacaccatcctcctgaaggcagccgaacttgggatggtgtcagcctattacacatacatcttcactaatctggagttctcactccagagaatggacagccttgtggatgatcgtgtcaacatcctgggattttccattttcaaccaatcccatgctttcttccaagagtttgcccagagcctcaaccagtcctggcaggagaactgtgaccatgtgcccttcactgggcctgcgctctcctcggccctgctgtttgatgctgtctatgctgtggtgactgcggtgcaggaactgaaccggagccaagagatcggcgtgaagcccttgtcctgcggctcggcccagatctggcagcacggcaccagcctcatgaactacctgcgcatggtagaattggaaggtcttaccggccacattgaattcaacagcaaaggccagaggtccaactacgctttgaaaatcttacagttcacaaggaatggttttcggcagatcggccagtggcacgtggcagagggcctcagcatggacagccacctctatgcctccaacatctcggacactctcttcaacaccaccctggtcgtcaccaccatcctggaaaacccatatttaatgctgaaggggaaccaccaggagatggaaggcaatgaccgctacgagggcttctgtgtggacatgctcaaggagctggcagagatcctccgattcaactacaagatccgcctggttggggatggcgtgtacggcgttcccgaggccaacggcacctggacgggaatggtcggggagctgatcgctaggaaagcagatctggctgtggcaggcctcaccattacagctgaacgggagaaggtgattgatttctctaagccattcatgactctgggaattagcattctttaccgcgttcatatgggacgcaaacccggctatttctccttcctggacccattttctccgggcgtctggctcttcatgcttctagcctatctggccgtcagctgtgtcctcttcctggtggctcggttgacgccctacgagtggtacagcccacacccatgtgcccagggccggtgcaacctcctggtgaaccagtactccctgggcaacagcctctggtttccggtcggggggttcatgcagcaaggctccaccatcgcccctcgcgccttatccacccgctgtgtcagtggcgtctggtgggcattcacgctgatcatcatctcatcctacacggccaacctggcagccttcctgaccgtgcagcgcatggatgtgcccattgagtcagtggatgacctggctgaccagaccgccattgaatatggcacaattcacggaggctccagcatgaccttcttccaaaattcccgctaccagacctaccaacgcatgtggaattacatgtattccaagcagcccagcgtgttcgtgaagagcacagaggagggaatcgccagggtgttgaattccaactacgccttcctcctggaatccaccatgaacgagtactatcggcagcgaaactgcaacctcactcagattgggggcctgctggacaccaagggctatgggattggcatgccagtcggctcggttttccgggacgagtttgatctggccattctccagctgcaggagaacaaccgcctggagatcctgaagcgcaaatggtgggaaggagggaagtgccccaaggaggaagatcacagagctaaaggcctgggaatggagaatattggtggaatctttgtggttcttatttgtggcttaatcgtggccatttttatggctatgttggagtttttatggactctcagacactcagaagcaactgaggtgtccgtctgccaggagatggtgaccgagctgcgcagcattatcctgtgtcaggacagtatccacccccgccggcggcgcgccgcagtcccgccgccccggccccccatccccgaggagcgccgaccgcggggcacggcgacgctcagcaacgggaagctgtgcggggcaggggagcccgaccagctcgcgcagagactggcgcaggaggccgccctggtggcccgcggctgcacgcacatccgcgtctgccccgagtgccgccgcttccagggcctgcgggcacggccgtcgcccgcccgcagcgaggagagcctggagtgggagaaaaccaccaacagcagcgagcccgagtag

SEQ ID NO: 710 - DNA, 1303 bp, Homo sapiens
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcg

SEQ ID NO: 711 - DNA, 8429 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttcaaaaaa

SEQ ID NO: 712 - DNA, 8265 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaataaaaaaaaaaaaaaaaaaaaaaaaaaaaaaaaaa

SEQ ID NO: 713 - DNA, 2559 bp, Homo sapiens
atgctgggccctgctgtcctgggcctcagcctctgggctctcctgcaccctgggacgggggccccattgtgcctgtcacagcaacttaggatgaagggggactacgtgctgggggggctgttccccctgggcgaggccgaggaggctggcctccgcagccggacacggcccagcagccctgtgtgcaccaggttctcctcaaacggcctgctctgggcactggccatgaaaatggccgtggaggagatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggcagctcctggagaacatgtacaacctgaccttccacgtgggcgggctgccgctgcggttcgacagcagcggaaacgtggacatggagtacgacctgaagctgtgggtgtggcagggctcagtgcccaggctccacgacgtgggcaggttcaacggcagcctcaggacagagcgcctgaagatccgctggcacacgtctgacaaccagaagcccgtgtcccggtgctcgcggcagtgccaggagggccaggtgcgccgggtcaaggggttccactcctgctgctacgactgtgtggactgcgaggcgggcagctaccggcaaaacccagacgacatcgcctgcaccttttgtggccaggatgagtggtccccggagcgaagcacacgctgcttccgccgcaggtctcggttcctggcatggggcgagccggctgtgctgctgctgctcctgctgctgagcctggcgctgggccttgtgctggctgctttggggctgttcgttcaccatcgggacagcccactggttcaggcctcgggggggcccctggcctgctttggcctggtgtgcctgggcctggtctgcctcagcgtcctcctgttccctggccagcccagccctgcccgatgcctggcccagcagcccttgtcccacctcccgctcacgggctgcctgagcacactcttcctgcaggcggccgagatcttcgtggagtcagaactgcctctgagctgggcagaccggctgagtggctgcctgcgggggccctgggcctggctggtggtgctgctggccatgctggtggaggtcgcactgtgcacctggtacctggtggccttcccgccggaggtggtgacggactggcacatgctgcccacggaggcgctggtgcactgccgcacacgctcctgggtcagcttcggcctagcgcacgccaccaatgccacgctggcctttctctgcttcctgggcactttcctggtgcggagccagccgggctgctacaaccgtgcccgtggcctcacctttgccatgctggcctacttcatcacctgggtctcctttgtgcccctcctggccaatgtgcaggtggtcctcaggcccgccgtgcagatgggcgccctcctgctctgtgtcctgggcatcctggctgccttccacctgcccaggtgttacctgctcatgcggcagccagggctcaacacccccgagttcttcctgggagggggccctggggatgcccaaggccagaatgacgggaacacaggaaatcaggggaaacatgagtga

SEQ ID NO: 714 - DNA, 765 bp, Homo sapiens
atgatctctgtggttttggaattggcgctaggctttgcattggctccagggagttccacgctgtccagttctctctgccgtgataaacctctgcggcccgtcatcctgagtcccaccatggaggagggccatgggctggacctcacttacatcacggagcgcatcatcgctgtgtccttccctgccggctgctctgaggagtcctacctgcacaacctacaggaggtcacgcgcatgctcaagtccaagcacggggacaactacctggtattaaacctttcagaaaagagatatgaccttacgaagcttaacccaaagatcatggatgtgggctggccagagctccacgcaccgcccctggataagatgtgtaccatatgcaaggcgcaggagtcctggctgaacagcaacctccagcatgtggtcgtcattcactgcaggggcgggaaaggacgcataggagtggtcatatcatcctacatgcatttcaccaacgtctcagccagcgccgaccaggcccttgacaggtttgcaatgaagaagttttatgatgacaaagtttcagctttaatgcagccttcccaaaaacggtatgttcagttcctcagtgggctcctgtccggatcggtgaaaatgaatgcctctcccctgttcctgcattttgtcatcctccacggcacccccaacttcgacacaggtggagtgtgccggccctttctgaagctctaccaagccatgcagcctgtgtacacctccgggatctag

SEQ ID NO: 715 - DNA, 1580 bp, Homo sapiens
aaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctt

SEQ ID NO: 716 - DNA, 2527 bp, Homo sapiens
aggaggtagtgactggcatacatggctcagtttgtccaggtcctggctgaaataggtgactttggtcgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgagttcaacctggtttgtgatcggaagcacctgaaggacaccacacagtcagtgttcatgggtgggctccttgttggcaccctcatgtttgggcccctctgcgaccggattggccgcaaggccacaatcctggcgcagctgctcctcttcaccctcatcggcctggccacagcttttgtgcccagctttgagctctacatggccctgcgctttgctgtggctactgccgtcgctggacttagcttcagcaatgtcaccctactgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctgggctctgccagaatctgcacgttggctcctgacccgtgggaggatggacgaggcgatacaactgatccagaaggcggcctcggtcaataggcggaaactctccccggagctcatgaaccagctggtcccagagaagacaggcccctcagggaatgccctggatctgttcagacacccccagctccggaaggtgaccctgattatcttctgtgtctggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcagatctgcccgtggtggtcaccatgctggctgtggtggggaagatggccacagctgctgcctttaccatctcctatgtgtactctgccgagcttttccccaccatcctccggcagacaggcatggggctggtgggcatcttctcacggatcgggggcatcctcacaccacttgtgatcctgctgggagagtaccacgctgccctccccatgctcatctacggcagcctccccatcgtggccggcctgctgtgcaccctgctgccagagacccatggccagggcctgaaagacaccctccaggacctggagctggggcctcacccacggtcccccaaatcagtgccctcagagaaggaaacagaggccaagggaagaacttccagcccgggagtggcctttgtgagcagcacatacttctgattgaggtctctaagagctggaccatcagcagcagggagctgcctaaacacctccttggatatggccaggacccacagggacacagggcaagaccagccttgcttatggaggcaggacaccacaatctggcccatggctgtcacctcctgccgagtccaatcccagactgggaaccaccatctgagacaggacctcccggcctccttcacctttctcatctccagagccctgcccccaatactctgtctgggttaggatcttgggtatgtcttggaattaacttgtcctctaacaatcttcatggggtatggctctcttgatctcctcaatctggagtcccctgccctcaaaacacagtgatgttcagaacagaacacaaggtaagccctttccaatttgtgggaacaggaggggagaggaaacaaatgtgaagttgtggactctacccaggcaggtggatgaaaatgctgtggataaaaggaaggttatgattccttctagcggatggaccagattcctctggctaacgtatggccccataggtcactgggtcatacagagagaagattcagttcagcctaaatcaaaacttccaccttgtgttcacttcaaagatggcccaacccccgccctacactcagctcatgcctaacctatgtgtggctcagggaccagcttggggaaggaaaggaggtttgttctgctccccgcctcaccccgcctcctcctgctcatgctcagctgcttctggaccttccagggcccatgcagggtgagggaaagggtagaggtcttttcaccgagctgctgctggttgcagttctttctggtgcacattggctaatgccag

SEQ ID NO: 717 - DNA, 816 bp, Homo sapiens
atgcactttctttgccaaaggcaaacgcagaacgtttcagagccatgaggatgcttctgcatttgagtttgctagctcttggagctgcctacgtgtatgccatccccacagaaattcccacaagtgcattggtgaaagagaccttggcactgctttctactcatcgaactctgctgatagccaatgagactctgaggattcctgttcctgtacataaaaatcaccaactgtgcactgaagaaatctttcagggaataggcacactggagagtcaaactgtgcaagggggtactgtggaaagactattcaaaaacttgtccttaataaagaaatacattgacggccaaaaaaaaaagtgtggagaagaaagacggagagtaaaccaattcctagactacctgcaagagtttcttggtgtaatgaacaccgagtggataatagaaagttgagactaaactggtttgttgcagccaaagattttggaggagaaggacattttactgcagtgagaatgagggccaagaaagagtcaggccttaattttcagtataatttaacttcagagggaaagtaaatatttcaggcatactgacactttgccagaaagcataaaattcttaaaatatatttcagatatcagaatcattgaagtattttcctccaggcaaaattgatatacttttttcttatttaacttaacattctgtaaaatgtctgttaacttaatagtatttatgaaatggttaagaatttggtaaattagtatttatttaatgttatgttgtgttctaataaaacaaaaatagacaactgttc

SEQ ID NO: 718 - DNA, 1695 bp, Homo sapiens
caagcaggatacgtttttctgttgggcattgactagattgtttgcaaaagtttcgcatcaaaaacaaacaacaacaacaaaaaaccaaacaactctccttgatctatactttgagaattgttgatttctttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaatttttttaaa

SEQ ID NO: 719 - DNA, 1723 bp, Homo sapiens
actccgaatgcgaagttctgtcttgtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaaaagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggaaaaaaaaaaaaaaa

SEQ ID NO: 720 - DNA, 890 bp, Homo sapiens
atggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaagatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaa

SEQ ID NO: 721 - DNA, 1396 bp, Homo sapiens
gcgtaattaaaaggcggcggaagaaggtgggagggtcatgacgcagcgagtttcagtcgtgacttttctgggggcatcgcggcgtccccttttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcaaaaaaaaaaaaaaaaaaa

SEQ ID NO: 722 - DNA, 2487 bp, Homo sapiens
ctgccttctagtttttagtctcagaccagaccaccgggcgcgccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgagctcccccaccctgacagtgagatgtgtcttcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcagggtgggctcagaggccactgagatgccagttccttgagagcagtgggggtgtcccaggccagagcagcctcttcctctcctggtcccagaaaaacccttgcagtaaatggtggcctctgggtggttaaaaaaaaaaaaaaaaaaaaaaaaaaaaaaaaaaaaaaaaaaaaaaaaaaaaaa

SEQ ID NO: 723 - DNA, 1182 bp, Homo sapiens
ggttcctccccactctgtctttctcacctctccttcacttttcctagcctcctcaccaccatctgatctatcttgttctcttcacaaaaggctctgaagacatcatgaacccacaacgggaggcagcacccaaatcctatgctattcgtgattctcgacagatggtgtgggtcctgagtggaaattctttaatagcagctcctcttagccgcagcattaagcctgtcactcttcatttaatagcctgtagagacacagaattcagtgacaaggaaaagggtaatatggtttacctgggaatcaagggaaaagatctctgtctcttctgtgcagaaattcagggcaagcctactttgcagcttaagcttcagggctcccaagataacatagggaaggacacttgctggaaactagttggaattcacacatgcataaacctggatgtgagagagagctgcttcatgggaacccttgaccaatggggaataggagtgggtagaaagaagtggaagagttcctttcaacatcaccatctcaggaagaaggacaaagatttctcatccatgcggaccaacataggaatgccaggaaggatgtagaaataaggggaggaagattcccatctctacaatctttgagtgggtttgctatcaatgaaatgctacaaatggaataagttgcagaaatttttctcttttcttgggttctggagagtttgtaaaacaaggacactatgtatttttaaagagttggtaaatcttacctgtaaagctagagaaggtcggagtctttttaggagtagatttggactacataacctgtaaatgtgttttgtccagtccttagagtgttttttaaaaaattgtaaagtcaaggttttcatgaaaaatgggaagatcagacaacattgctcctgaattcccacagagcagcaagctactagagctcaatctgttatttcttttcctgatgtacaggggttaagtcctatggaagaaacagcagaattattcaaaattatttacataatgtgcaattattcactagagcatgaggagtgaaacgctctgtttagtatgtataacttaaaaggaacacatacaattaaaagtaattgaaagacatttcttcttaaaaattctataatcttacactggtaaaataaactagtttttcccatgt

SEQ ID NO: 724 - DNA, 1182 bp, Homo sapiens; identical to SEQ ID NO: 723

SEQ ID NO: 725 - DNA, 5426 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcaggctggggatatagcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagag

SEQ ID NO: 726 - DNA, 5307 bp, Homo sapiens
aatgctgtgagttccttgttaggcctctccttccgatgaaaagagaaaggaagaatggactacagccaccaaacgtccctagtcccatgtggacaagataaatacatttccaaaaatgaacttctcttgcatctgaagacctacaacttgtactatgaaggccagaatttacagctccggcaccgggaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcagggaaccactctgaagcccctgactgtgcccaaagttcagatctcagaggtggatgccccgccggagggtgaccagatgccaagctccacagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataagacatccgtgttcacaccagcctatggctctgtcaccaacgtccgcatcaacagcaccatgaccaccccacaggtcctgaagctgctgctcaacaaatttaagattgagaattcagcagaggagtttgccttgtacgtggtccatacgagtggtgagaaacagaagctgaaggccaccgattacccgctgattgcccgaatcctccagggcccatgtgagcagatctccaaagtgttcctaatggagaaggaccaggtggaggaagtcacctacgacgtggcccagtatataaagttcgagatgccggtacttaaaagcttcattcagaagctccaggaggaagaagatcgggaagtaaagaagctgatgcgcaagtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggaggacccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttactggacagcgatttctggcttataagagttctctttgatttgcactagcactacgatagtgttagatggggaaatactgcaacatgtccagttggccagatcactttccaagggagcgatactaaggcagactcagctttttaaagatgggaggtcaggaggtggaagtgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagagaaaaaaaaaaaaaaaaaaaaaaa

SEQ ID NO: 727 - DNA, 2538 bp, Homo sapiens
gctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtgtctgtccaagctcgtaatgagactatagcaaggcggctgtgggacgtcagttgtgacctgctgggcctcccaatagactaacaggcagtgccagttggacccaagagaagactgcagcagactacacagtacttcttgtcaaaatgattctccttcaaggttttcaaaacctttagcacaaagagagcaaaaccttccagccttgcctgcttggtgtccagttaaaactcagtgtactgccagattcgtctaaatgtctgtcatgtccagatttactttgcttctgttactgccagagttactagagatatcataataggataagaagaccctcatatgacctgcacagctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcccaggcatggtggatcaccggaggtcagtagttcaagaccagcctggccaacatggtgaaaccccacctctactaaaaattgtgtatatctttgtgtgtcttcctgtttatgtgtgccaagggagtattttcacaaagttcaaaacagccacaataatcagagatggagcaaaccagtgccatccagtctttatgcaaatgaaatgctgcaaagggaagcagattctgtatatgttggtaactacccaccaagagcacatgggtagcagggaagaagtaaaaaaagagaaggagaatactggaagataatgcacaaaatgaagggactagttaaggattaactagccctttaaggattaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaatcctaaaaacaaacaaacaaaaaaaacaattcttcattcagaaaaattatcttagggactgatattggtaattatggtcaatttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaagattttgatttcctggaatgacaattatattttaactttggtgggggaaagagttataggaccacagtcttcacttctgatacttgtaaattaatcttttattgcacttgttttgaccattaagctatatgtttagaaatggtcattttacggaaaaattagaaaaattctgataatagtgcagaataaatgaattaatgttttacttaatttatattgaactgtcaatgacaaataaaaattctttttgattattttttgttttcatttaccagaataaaaactaagaattaaaagtttgattacagtcaaaaaaaaaaaaaaaaaaaaaaa

SEQ ID NO: 728 - DNA, 1723 bp, Homo sapiens
aagtttgcattttcctctgttcttgagcccagcttcttctcgtctcccaccccagcttcccggcattggaagaagggaccgtcctcttccttgtcttggccacccaaatcctggtatcgaaagggttgaacggaccggaagtgtgcagcagcgacgggtccccagctaatcgacgccggaagtagcaattactagacaagcattccgccgccggcttcgctatggcggcaattcccccagattcctggcagccacccaacgtttacttggagaccagcatgggaatcattgtgctggagctgtactggaagcatgctccaaagacctgtaagaactttgctgagttggctcgtcgaggttactacaatggcacaaaattccacagaattatcaaagacttcatgatccaaggaggtgacccaacagggacaggtcgaggtggtgcatctatctatggcaaacagtttgaagatgaacttcatccagacttgaaattcacgggggctggaattctcgcaatggccaatgcggggccagataccaatggcagccagttctttgtgaccctcgcccccacccagtggcttgacggcaaacacaccatttttggccgagtgtgtcagggcataggaatggtgaatcgcgtgggaatggtagaaacaaactcccaggaccgccctgtggacgacgtgaagatcattaaggcatacccttctgggtagacttgctaccctcttgagcagctcttctgagatggccccagtgaaccagcttctagatgacatagaatgacatgtaatgctaaatttcattttggctttgcaagtcatgaagcttaggaggcctggcatcttgggtgagttagagatggaagtacattttaataggatgcttcttttctcttcccccagtgcctaggttgccagagcatttgcacaaatgcccctgtttatcaataggtgactacttactacacatgaaccataatgctgcttcttgtgcatgtctgctctgatatacgtcgaacaatgtagcagccactgtcatttctcagtggttttgcctaaccaaacttcttcctaaggagatttatattctggcctacacagcagtccttgatggctgacagccacagaattccaaaccaagtagtgtctgtcagccctcttaactctgtgcacgccctatttcagtcttttacatttgttcttctagggaatgtatgcatctctatatatattttccctctcaaaaccagaacatcaacagtgctgtttctgacacttcagacatcccacgcaaagccacattgaatttttgccaaatgaaaaacacatccaacaatcaagtttctaagaaggtgtcaagtggggaataataataatgtataataatcaagaaattagtttattaaaaggaagcagaagcattgaccattttttcccagagaagaggagaaatctgtagtgagcaaaggacagaccatgaatcctccttgagaagtagtactctcagaaaggagaagcgccactcaagttcttttaacccaagactttagagaaattaggtccaagatttttatatgttcagttgtttatgtataaaaataactttctggattttgtggggaggagcaggagaggaaggaagttaatacctatgtaatacatagaaacttccacaataaaatgccattgatggttgaaaaaaaaaaaaaaaaaaa

SEQ ID NO: 729 - DNA, 829 bp, Homo sapiens
ggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgccca

SEQ ID NO: 730 - DNA, 1128 bp, Homo sapiens
gcttctcgttgtgccccgcccgcaagcgccctcctccgggccttcgtgacagccaggtcgtgcgcgggtcatcctgggattggtagttcgctttctctcatttagccagtttctttctctaccggggactccgtgtcccggcatccaccgcggcacctgacccttggcgcttgcgtgttgccctcttccccaccctccctaatttccactccccccaccccacttcgcctgccgcggtcgggtccgcggcctgcgctgtagcggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggcc

SEQ ID NO: 731 - DNA, 2062 bp, Homo sapiens
gcggctccagtccgaaggcagcggccgggggagggaaggaggggaccgaacccccgaggagtttcgcagaatcaacttctggttagagttatgggaagcgcggttatggacaccaagaagaaaaaagatgtttccagccccggcgggagcggcggcaagaaaaatgccagccagaagaggcgttcgctgcgcgtgcacattccggacctgagctccttcgccatgccgctcctggacggagacctggagggttccggaaagcattcctctcgaaaggtggacagccccttcggcccgggcagcccctccaaagggttcttctccagaggcccccagccccggccctccagccccatgtctgcacctgtgaggcccaagaccagccccggctctcccaaaaccgtgttcccgttctcctaccaggagtccccgccacgctcccctcgacgcatgagcttcagtgggatcttccgctcctcctccaaagagtcttcccccaactccaaccctgctacctcgcccgggggcatcaggtttttctcccgctccagaaaaacctccggcctctcctcctctccgtcaacacccacccaagtgaccaagcagcacacgtttcccctggaatcctataagcacgagcctgaacggttagagaatcgcatctatgcctcgtcttcccccccggacacagggcagaggttctgcccgtcttccttccagagcccgaccaggcctccactggcatcaccgacacactatgctccctccaaagccgcggcgctggcggcggccctgggacccgcggaagccggcatgctggagaagctggagttcgaggacgaagcagtagaagactcagaaagtggtgtttacatgcgattcatgaggtcacacaagtgttatgacatcgttccaaccagttcaaagcttgttgtctttgatactacattacaagttaaaaaggccttctttgctttggtagccaacggtgtccgagcagcgccactgtgggagagtaaaaaacaaagttttgtaggaatgctaacaattacagatttcataaatatactacatagatactataaatcacctatggtacagatttatgaattagaggaacataaaattgaaacatggagggagctttatttacaagaaacatttaagcctttagtgaatatatctccagatgcaagcctcttcgatgctgtatactccttgatcaaaaataaaatccacagattgcccgttattgaccctatcagtgggaatgcactttatatacttacccacaaaagaatcctcaagttcctccagctttttatgtctgatatgccaaagcctgctttcatgaagcagaacctggatgagcttggaataggaacgtaccacaacattgccttcatacatccagacactcccatcatcaaagccttgaacatatttgtggaaagacgaatatcagctctgcctgttgtggatgagtcaggaaaagttgtagatatttattccaaatttgatgtaattaatcttgctgctgagaaaacatacaataacctagatatcacggtgacccaggcccttcagcaccgttcacagtattttgaaggtgttgtgaagtgcaataagctggaaatactggagaccatcgtggacagaatagtaagagctgaggtccatcggttggtggtggtaaatgaagcagatagtattgtgggtattatttccctgtcggacattctgcaagccctgatcctcacaccagcaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacgataggtatttcttccagtgatgttgaaattaagcttaaaaaagaaagattttatgtgcttgaaaattcaggcttgcattaaaaaactgttttcagaccttgtctgaaggattttaaatgctgtatgtcattaaagtgcactgtgtccctg

SEQ ID NO: 732 - DNA, 2679 bp, Homo sapiens
ctccaggaaacagagtgaagacactggccctggcaggcagcagctgggtctaagagagctgcagcccagggtcacagacctgtgggccccatggccgggaaggcggcagaggagagagggctgccgaaaggggccactccccaggatacctcgggcctccaggatagattgttctcctctgaaagtgacaacagcctgtacttcacctacagtggccagcccaacaccctggaggtcagagacctcaactaccaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggttgtgggagagcctccttgctagatgtgatcactggccgaggtcacggcggcaagatcaagtcaggccagatctggatcaatgggcagcccagctcgcctcagctggtgaggaagtgtgtggcccacgtgcgccagcacaaccagctgctccccaacttgactgtgcgagagaccttggccttcattgcccagatgcggctgcccagaaccttctcccaggcccagcgtgacaaaagggtggaggacgtgatcgcggagctgcggcttaggcagtgcgctgacacccgcgtgggcaacatgtacgtgcgggggttgtcggggggtgagcgcaggagagtcagcattggggtgcagctcctgtggaacccaggaatccttattctcgacgaacccacctctgggctcgacagcttcacagcccacaacctggtgaagaccttgtccaggctggccaaaggcaaccggctggtgctcatctccctccaccagcctcgctctgacatcttcaggctgtttgatctggtcctcctgatgacgtctggcacccccatctacttaggggcggcccagcacatggtccagtatttcacagccatcggctacccctgtcctcgctacagcaatcctgctgacttctatgtggacctgaccagcattgacaggcgcagcagagagcaggaattggccaccagggagaaggctcagtcactcgcagccctgtttctagaaaaagtgcgtgacttagatgactttctatggaaagcagagacgaaggatcttgacgaggacacctgtgtggaaagcagcgtgaccccactagacaccaactgcctcccgagtcctacgaagatgcctggggcggtgcagcagtttacgacgctgatccgtcgtcagatttccaacgacttccgagacctgcccaccctcctcatccatggggcggaggcctgtctgatgtcaatgaccatcggcttcctctattttggccatgggagcatccagctctccttcatggatacagccgccctcttgttcatgatcggtgctctcatccctttcaacgtcattctggatgtcatctccaaatgttactcagagagggcaatgctttactatgaactggaagacgggctgtacaccactggtccatatttctttgccaagatcctcggggagcttccggagcactgtgcctacatcatcatctacgggatgcccacctactggctggccaacctgaggccaggcctccagcccttcctgctgcacttcctgctggtgtggctggtggtcttctgttgcaggattatggccctggccgccgcggccctgctccccaccttccacatggcctccttcttcagcaatgccctctacaactccttctacctcgccgggggcttcatgataaacttgagcagcctgtggacagtgcccgcgtggatttccaaagtgtccttcctgcggtggtgttttgaagggctgatgaagattcagttcagcagaagaacttataaaatgcctctcgggaacctcaccatcgcggtctcaggagataaaatcctcagtgtcatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatctaaaaaaaaaaaaaaa

SEQ ID NO: 733 - DNA, 6215 bp, Homo sapiens
gcagggagtgcgggtcggttctgcgtgcgctgccggacgaggctcccgccgccgattgacccgcgctccgcccgtagtcgggccgttctgttccaagagataaccattgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccgggaagagctgcaggaaaagccggaatggagacttcgagatgtgcaggcccttcgtgacatggtgcggaaggagtaccccaacctgagcacatccctcgacgatgccttcctgctgcgcttcctccgagcccgcaagtttgattacgaccgggccctgcagctcctcgtcaactaccacagctgtagaagaagctggcccgaagtcttcaataacttgaagccatcagccttaaaagatgtccttgcttccgggttcctcaccgtgctgccccacactgaccccaggggctgccatgtcgtctgcatccgcccagacagatggataccaagcaactatccaattactgaaaacatccgagccatatacttgaccttagaaaaactcattcagtctgaagaaacccaggtgaatggaattgtaattcttgcagactacaaaggagtgagtttatcaaaagcatctcactttggcccttttatagccaaaaaggtgattggcatcctccaggatggtttccccattcggataaaagcagtccatgtggtgaatgaacctcgaatatttaaaggcatttttgccatcataaaaccatttctaaaggagaaaatagcaaacagattcttcctccatgggtctgacttgaactctctccacacaaaccttccaagaagcatcctccccaaggagtatgggggcacggctggggagctggacactgccacctggaacgcggtactgctggcttcagaagacgattttgtgaaagagttctgccaacctgttcctgcctgtgacagcatcctgggccagacgctgctgcccgagggcctgacctcagatgcacagtgtgacgactccttgcgagctgtgaagtcacagctgtactcctgctactagcccgtcccccagggtcaccatctttaattcttttccttcttttctttggagaggcacaaggagaatttaagggtccatggattcagtcttgctccttgtaattaaactgcaggatggaggaacagcctgagatatgagcatgagcccattttggggtaagcctttggttactttaattactccatggaagacatggaaaatgtccccactgattcttaaacatttggaatcccagtctgcaactattaatctggaggctatatctattttgttttgctttttggttggggggtggtgatctggttcttacacatcttggaagcaagaacaatcaggaccaaagtcactttgatcccacttttccaggagaaaaaccacctgtttggccagtgagaactacttgtatgaaataatttggccaaaccttcagtgtgaccaaatgtgagactgggagtttgtgtttttcacaggaaccctaagtatagacctctgctgctcatcaggaaacttactggagatgaaggccccagctgttgtcaccgggtttggaaagcaccttaactgaatcatgtaagcatcaggacataagcagcactttgtggtcaaatgtggaagccggagacttcaaagcacctctgggacccactggttgaagtttgcaatagaaacttaagttttcccaaatccataaagccttagccctggttctcaatagaatcagggacctagcaggaaatgattttactcaacctaaaatgctggatcccaggcccgtgtagctataagaattctggcctggatcccaggtgtacaactatggacaagatatgggcctctactttctcctctataaaatgaggctggatgaaatgtcagctagggccattttggctgctgaggctctgggatttggtttagttactgaatgttagattttctgcctagaaagataactatctagatacaagtggttggatcctgtttttgtttgtggtacatgtgtctttccaagagagatgtgtcaccaattagccctgcctttaaagaaactattatgtgtattcctgggactcactgacaccaattttctttttatagtgatggttcaattttgaaaagatggcttttgtgaggccaggttaaggtgaccaggatcttgtatgatgaattccttccatccctgagactctggtactatattgtaaacctggctacagtagttaattacttgagattctttaattttggtctctgagctgggcgtggtggttcatgcctgtaatcccagcactttgggaggccaaggtgtgcggatcacaaggtcaggagttcgagacccgcctggccaagatggtgaaaccccatctctactaaaaatacaaaaattagctgggcgtggtggcgggctcctgtagtcccagctactcgggaggctgaggcagaagaatcacgtgaacccaggaggcagaagtggcagtgagccaagatcgcaccactgcactccagcctgggcgacagagcaagactctgcctcaaaaaaaaaaaaaaaaaaaaaaaatttttttttttttggtctctggaaatgaacacaagggcaggttattcctgggtcacttctgggcccccctgccctcccagccccacttgagtttctctctctggtgtgggtgaaccagtcagcctgaatgttctgcatttcagcactttagaacctccctgtgaagattttagccttagcccaaacatcaaattagacggttcacatgatggtttttgacctatttcctttctaatgtattccacatgatcatggtgttaaatagtgaaaagtactgtgttgtgtgtgcaccttctccgtgcatttattagactaaccagtcaagcagacagctcagttagggagaaaacaatactctgaaatttgaaggccaatctgttgttactaagctgtttatctctattgcctttttaaatgtctggataagttgttggtggaaattaagttacttaacctcattaataccaattctagagaaagttcttttcaccatggatagtaaccctggatcctctacggtactggctgagctggaagtgccaaaaagcactcctggctgcttctggttccatctgatgatgatgtgacacacactgctgaaaaggcccaagcagggcaagtgggatggctgaaggagggaaggagggggttcagaacccactggcctggatgggagaactgggtggaggcttccccaagagggaagacagataaacaaaacaaaacaaaaactgggtaaagaggaatgaatcactcagccctgatgtttcaattctacactgcattcctggccagtcgcatttgttttaatgcaggcatggccacagctctcctagagaattatctcaaagaccagaagggacctggagaggcctatttcttaggtttttccagttggacaaggaaggagtggtttcactcagcttctagaaggagttggagcctaagtttatctgcctccgggagctgcttgctttgttttggctccgaagaggtatcagatagttttgacacctcaggaaacttgaaccaagctgtgaaaccaagacctccctgcgtgaaaatcaaggtggtctccttgtggcttcaccaggatgtttgtgtcaggctgtctcagcagggtggggaatgaccagccagggagcacagtgagccttactcagcactggggagcgcactggtgaggcaaacccatgaacctcaagaactgggagtatgttccttcagggagaagttctggcccattgcacaaacacttggaaattaacttttccctaaattcaagatagtgtggtgtcggaaggaaatgggacagtaaattaggagacgcgggctccacctttaccttactacgtggcctttgatgagctggcttaacatccctgagtgattccatgatagagatctatactccaaactttattcctggtatctagttggcttcactgccacagacactgtactctctctttttagaagtttttttccttttttttccccctcaattggcttatttagtaaatttaggtctgaatgaattggtacctaaaagcttccaaatctatacatttcagaatatgggaattttcttcctcttcttcccccatatcccaacatggaattctggaaaactgtgcctcttcccctgttctgccttcatgggggagagactggatgaaatctacaaaaacagccaaaagtgccaccctggcttcatgtcttgaatttctaacttgctcttggcaaaggtcgctttattttttaatttttttccttgcattttcttttttattctattgctgctgcaaaaattaaggcaaaagtagctttcgatctttcatatttcatcctggtttcacaaggagtcacttatcttaggaggtctgtaagtcaggttacaaggccgggagcggtggctcacacctgtaatcccaacactttgagcggctgaggtgggtgtatcacctgaagtccggagtttgagaccagcctggccaacatggtgaaaccccgtctctactaaaaatacaaaaaattggctgggcatggtggtgggtgcctgtaatcccagctacttgggaagctgaagcaggagaatcacttaaacccaggtggcggaggttgcagtgagccgacatcgcgccattgcactccagcctgggtgacgagtgaaactccatctcaaaaataaaaattgaaaaatcaggttacaaaacaccatttttcccgaaataagacaataagaggcttttctctgaattcctttatattgagcctttcagaattctccctgggtgggcaatttctttaaatagtatttgaccctcagatcaatcctgggaatttttttcatttgggtagcaaaagctagagtattgctgtggcgattataatacttttaaaaagttttaccattttaaagttgccaacatttaattaaggttttcctttgaagcctcctttaatttagggagtaaaatgttagctaaaccaattatatactatatactatacactgtatctcctgtggccatgagaggtgtggctataccgaacagaaacatgcctactgttcaggaaagatgtcagttctggtaacacctctctgtattgggatctgttaattttgtaaatctaaattcttctgctcttggccaggtgcagtagttcatgccctgtaatcctagaactttgggaggctgaagggggggcggatcatttgaggtcaggagtttgagaccagcctggccaacatggtgaaaccccatctctactaaaaagtacaaaaattagctgggtgtggtggtgcgtgcctgtaatcccaactacttgggaggctgaggcaggagaatcgcttgaacctgggaggcagcggttgcagtaagccaagactatgccactgcactcccgcctgggtgacaaagcaatattctgtgtcaaataaataaattcattcttctgctctcctgacttagagaaatggtttgcttaaaatgctagtaacaaacatcacagtcaacaggagcttgcttcatgcgaaggatcaatgtgatttgtggatggagatgatagtgatgaaattcctgtttcatggggctgtttttcttttcatctcactgggcagcaggtttagtgaggcagtgagatgctgctgctgtggattcttgtagctatgcctcggcttcttggcatatcaggtaggaacctgttacaagtgaaatacttgaaacctctctgaccaagagcctctgatggagtgggaggtgagctaattctctgaccagcttggggcactgtttcagccactggtcacattccttgcttcaaactgaaattcagtttggctttgagtatagggatacatggtggattcatgtacttcagtgtttgttttgaccaaagtttatttttctagtgcattttctaagtcaaagtggtgaaaatatgtaataattttagtatgcatgactcagtctgaaacaataaaaatctctgaaaaatgtg

SEQ ID NO: 734 - DNA, 1983 bp, Homo sapiens
ggggcggggcgcgctacccgcagcccccggagctcggctaactcggcgcccagtgcacggccgcaccatggggtcccgccacttcgaggggatttatgaccacgtggggcacttcggcagattccagagagtcctctatttcatatgtgccttccagaacatctcttgtggtattcactacttggcttctgtgttcatgggagtcacccctcatcatgtctgcaggcccccaggcaatgtgagtcaggttgttttccataatcactctaattggagtttggaggacaccggggccctgttgtcttcaggccagaaagattatgttacggtgcagttgcagaatggtgagatctgggagctctcaaggtgtagcaggaataagagggagaacacatcgagtttgggctatgaatacactggcagtaagaaagagtttccttgtgtggatggctacatatatgaccagaacacatggaaaagcactgcggtgacccagtggaacctggtctgtgaccgaaaatggcttgcaatgctgatccagcccctatttatgtttggagtcctactgggatcggtgacttttggctacttttctgacaggctaggacgccgggtggtcttgtgggccacaagcagtagcatgtttttgtttggaatagcagcggcgtttgcagttgattattacaccttcatggctgctcgcttttttcttgccatggttgcaagtggctatcttgtggtggggtttgtctatgtgatggaattcattggcatgaagtctcggacatgggcgtctgtccatttgcattccttttttgcagttggaaccctgctggtggctttgacaggatacttggtcaggacctggtggctttaccagatgatcctctccacagtgactgtcccctttatcctgtgctgttgggtgctcccagagacacctttttggcttctctcagagggacgatatgaagaagcacaaaaaatagttgacatcatggccaagtggaacagggcaagctcctgtaaactgtcagaacttttatcactggacctacaaggtcctgttagtaatagccccactgaagttcagaagcacaacctatcatatctgttttataactggagcattacgaaaaggacacttaccgtttggctaatctggttcactggaagtttgggattctactcgttttccttgaattctgttaacttaggaggcaatgaatacttaaacctcttcctcctgggtgtagtggaaattcccgcctacaccttcgtgtgcatcgccatggacaaggtcgggaggagaacagtcctggcctactctcttttctgcagtgcactggcctgtggtgtcgttatggtgatcccccagaaacattatattttgggtgtggtgacagctatggttggaaaatttgccatcggggcagcatttggcctcatttatctttatacagctgagctgtatccaaccattgtaagatcgctggctgtgggaagcggcagcatggtgtgtcgcctggccagcatcctggcgccgttctctgtggacctcagcagcatttggatcttcataccacagttgtttgttgggactatggccctcctgagtggagtgttaacactaaagcttccagaaacccttgggaaacggctagcaactacttgggaggaggctgcaaaactggagtcagagaatgaaagcaagtcaagcaaattacttctcacaactaataatagtgggctggaaaaaacggaagcgattacccccagggattctggtcttggtgaataaatgtgccatgcctgctgtctagcacctgaaatattatttaccctaatgcctttgtattagaggaatcttattctcatctcccatatgttgtttgtatgtctttttaataaattttgtaagaaaattttaaagcaaatatgttataaaagaaataaaaactaagatgaaaaaaaaaaaaaaaa

SEQ ID NO: 735 - DNA, 3400 bp, Homo sapiens
ggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaaaaa

SEQ ID NO: 736 - DNA, 2357 bp, Homo sapiens
aggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 737 - DNA, 4471 bp, Homo sapiens
ttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaataaatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaagcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagatttttaccatgtctctaagccaactttaattgcttaaaagacatttttatttagttgaaaaatctagttttttttgtaaactgtaccaaatctgtatatgttgtaataaaacttatgctagtttattggaagtgttcaagaaataaaaatcaacttgtgtactgataaaatactctagcctgggccagagaagataatgttctttaatgttgtcaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctcttggatggacccacgaacgctcttagctttctcagggggtcagcagagttattgaatcttaattttttttaatgtacaagttttgtataaataataaagaactccttattttgtattacatctaatgcttaagtgttgctcttggaaagctgatgatgtctcttgtagagatgactctgaaaaacattccaggaaaccatggcagcatggagagcctcttagtgattgtgtctgcattgttattgtggaagatttaccttttctgttgtacgtaaagcttaaattacttttgttgtgactttttagccagtgactttttctgagcttttcatggaagtggcagtgaaaaatatgttgagtgttcaaaaaagtgactgtaattaatatcttgctggattaatgttttgtacaattactaaattgtatacattttgttatagaatacttttttctagtttcagtaaataatgaaaaggaagttaatacca

SEQ ID NO: 738 - DNA, 2592 bp, Homo sapiens
ggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcaaaaaaaaaaaaaaaaaaaaaaaaaaaaaaaaaaaaaaaaaaaaaaaaaaaaaaaa

SEQ ID NO: 739 - DNA, 4242 bp, Homo sapiens
gaattcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgatgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctgaggttcaggaggatgtatgccctcatccagcactaccgcgagacgcacctgccgtgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatacggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaaggagcagggcgatcctccggtggagtttgccacagacagggtggaggagctctttgagtggtttcagagcatccgagagatcacgtggaagattgacagcaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatggcaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccactccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaacttctaacttatatctttatagaggattccccaaaatgtgctcctcatttttggcctctcatgttccaaacctcattgaataaaaagcaatgaaaaccttg

SEQ ID NO: 740 - DNA, 3694 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaaaaaaaaaa

SEQ ID NO: 741 - DNA, 3826 bp, Homo sapiens
gaattcgggtggagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctgaaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtcttggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagttttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttaggcgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagacatacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcagcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacaggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaacccgaattc

SEQ ID NO: 742 - DNA, 3813 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 743 - DNA, 3576 bp, Homo sapiens
ggcagttagcccgcccgctcggcgcagggcgtggcttctcgtagccattaggaaacagcaaccctttcacctcagttttcttcactccggcatttgcagcagagcgaaaggtggtcgagtcctgaaggagggcctgatgtcttcatcattctcaaattcttgcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttgggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataataaaaaaaaaaaaaaaaa

SEQ ID NO: 744 - DNA, 4646 bp, Homo sapiens
gggaggcggtggccgaggcccaggcggtggcggcggcggcccaggaggcggcggacggggagctgcgggagcaggcccgggcctggctctctagcggccgcctggctgcagcatgcgcgcccgccgggggctgctgcggctgccgcgccgctcgctgctcgccgcgctcttcttcttttctctctcgtcctcgctgctgtacttcgtctatgtggcgcccggcatagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcagattatcctcttgacttgaaccacagtgaaaccttcctgcaaactacaacatttcttcctgaagacttcacctactttgcaaaccatacctgccctgaaagactcccttccatgaagggcccaatagacataaacatgagtgaaattggaatggattacattcatgaactcttctccaaagacccaaccatcaagctcggaggtcactggaagccttctgattgcatgcctcggtggaaggtggcgatccttatccccttccggaaccgccacgagcacctcccagtcctgttcagacacctgcttcccatgctccagcgccagcgcttgcagtttgcattttatgtggttgaacaagttggtacccaaccctttaatcgagccatgcttttcaacgttggctttcaagaggcaatgaaagacttggattgggactgtttgatttttcatgatgtagatcacataccggaaagtgatcgcaactattatggatgtggacagatgccgaggcattttgcaaccaaattggataagtatatgtatctgcttccttataccgagttctttggcggagtgagtggcttaacagtggaacaatttcggaaaatcaatggctttcctaatgctttctggggttggggtggagaagatgacgacctctggaacagagtacagaatgcaggctattctgtgagccggccagagggtgacacaggaaagtacaagtccattcctcatcaccatcgaggagaagtccagtttcttggaaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcatttttttaaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttcccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacaggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttgtttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaa

SEQ ID NO: 745 - DNA, 1208 bp, Homo sapiens
gcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggttcgaacctctgacatgggtggctatgctacttgccatgacttcactgaggctgtcattgctgccttgccccacccataggccctgtccatacccatgtaaggtgttcaataaagaacatgaaccaa

SEQ ID NO: 746 - DNA, 1539 bp, Homo sapiens
gcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaaccaaaaaaaaaaaaaaaaaa

SEQ ID NO: 747 - DNA, 1645 bp, Homo sapiens
gcgggaaacatggcggcattgagcggagtccgctggctgacccgagcgctggtctccgccgggaaccctggggcatggagaggtctgagtacctcggccgcggcgcacgctgcatcgcggagccaggccgaggacgtgagggtggagggctcctttcccgtgaccatgcttccgggagacggtgtggggcctgagctgatgcacgccgtcaaggaggtgttcaaggctgccgctgtcccagtggagttccaggagcaccacctgagtgaggtgcagaatatggcatctgaggagaagctggagcaggtgctgagttccatgaaggagaacaaagtggccatcattggaaagattcataccccgatggagtataagggggagctagcctcctatgatatgcggctgaggcgtaagttggacttatttgccaacgtagtccatgtgaagtcacttcctgggtatatgactcggcacaacaatctagacctggtgatcattcgagagcagacagaaggggagtacagctctctggaacatgaggtgaggccccagaaactgggggagggcaaggatgaagatgggagagaggtggagctccttgtttcccttcccagtgtcacctagctgctgctttcttcttacccagagtgcaaggggtgtgattgagtgtttgaagattgtcacacgagccaagtctcagcggattgcaaagttcgcctttgactatgccaccaagaaggggcggggcaaggtcactgctgtccacaaggccaacatcatgaaacttggggatgggttgttcctgcagtgctgtgaggaagttgctgaactgtaccccaaaatcaaatttgagacaatgatcatagacaactgctgcatgcagctggtgcagaatccttaccagtttgatgtgcttgtgatgcccaatctctatgggaacattattgacaatctggctgctggcctggttgggggagctggtgtggtccctggtgagagctatagtgcagaatacgcagtctttgagacgggtgcccggcacccatttgcccaggcagtgggcaggaatatagccaatcccacggccatgctgctgtcggcttccaacatgctgcggcatcttaatcttgagtatcactccagcatgatcgcagatgcggtgaagaaggtgatcaaagttggcaaggtgcggactcgagacatgggcggctacagcaccacaaccgacttcatcaagtctgtcatcggtcacctgcagactaaagggagctagagccctttatttcttccaaccttgcaaggaccacactccccatacccttcagtgcagtgtaccagggaagagaccttgtgcctctaagcagtggaccatggtcaccttgctgggtagagcctaggttgtccttgggccggcttccttaggggacagactgttgggtggtgatggggattgttaggatggagcccaggccacatggatgatgatgattctcccccacaggttcgaacctctgacatgggtggctatgctacttgccatgacttcactgaggctgtcattgctgccttgccccacccataggccctgtccatacccatgtaaggtgttcaataaagaacatgaaccaaaaaaaaaaaaaaaaaa

SEQ ID NO: 748 - DNA, 2479 bp, Homo sapiens
cgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgggccaggagtattaggaaggagacctggaccctggtagggagctcagcacaagctcgcctgacccagatggtattggacacagtgccccgctgaacagcagctgttcccagcgccagaggaccccacagccacagtaggagctttgcgacccctacgcaactgcagctggggctggggccaccaggagaagggaccagcacctcagatgggaagcagaagggcaagacctactgcggaaaggatctcgatctctgcagcggagttttcccacactcacagagcttcctgtttttgtcctctcagggttggggtctggctcccctcctctggcagaggttttgggccaggaggtgggacaacacttgcatggaacccaagtcccctgaagcccctgtgctctctgttgtgattggagttctagggcttccccgctgccgggaacgaggggccgcctcattgtctgctcatgaaccacaaggaccccgactgctccagactggattatttcaagccgccaaagagggggacccctagagctggcagccagcaatcccaagggactagagggctgcaatggactgacctccccctcaccagggtggcaggagaggcagagcctctgtggcctagctagtgacggagagacccgatgaagccctaagcaggggccccgcctgactcagggacaggacagccactcctgccaacgtgtgttctccctacatgagggagggcgtggcaagggacccctgccactgtcccctgctgcagcacgtgcccctatgccctttgcatgtggtgccagaataggcaggctacgccgtggctggcccctcagcgggctgggaaaagagtggccacggtgaccgtcacccgcctgccggcaccatgaagtgctccctgcgggtgtggttcctctccgtggccttcctgctggtgttcatcatgtccctgctcttcacctactcgcaccacagcatggccacgctcccctacctggactcaggggccctggatgggacgcaccgggtgaagctggtgcccggctatgccggcctgcagcgcctcagcaaggagaggctctcgggcaagagctgtgcctgtcgccgctgcatgggcgatgccggtgcctccgactggtttgacagccactttgacggtaacatttcccccgtctggacccgagagaacatggatcttccaccggacgtccagaggtggtggatgatgctgcagccccagttcaagtcacacaacaccaatgaggtgctggagaagctgttccagatagtgcctggcgagaacccctaccgcttccgggacccccaccagtgccggcgctgtgccgtggtggggaactcgggcaacctgcggggctctggctatgggcaggacgtggacgggcacaacttcatcatgaggatgaatcaggcgccaaccgtgggctttgagcaggatgttggcagccgaaccacccaccatttcatgtaccctgagagtgccaagaacctgcccgccaacgtcagcttcgtgctggtgcccttcaaggtcctggaccttctgtggatcgccagcgccttgtccacggggcagatccgattcacctacgccccagtgaagtccttccttcgagtggataaagaaaaggtccagatctacaacccagccttcttcaagtatatccacgacaggtggacagagcatcacgggcggtacccttccacggggatgctggtgcttttctttgccctgcatgtgtgtgatgaggtgaacgtgtacgggttcggggccgacagccggggcaactggcaccactactgggagaacaaccggtacgcgggcgagttccggaagactggcgtgcacgacgcggacttcgaggcccacatcatcgacatgctggccaaggccagcaagatcgaagtctaccggggcaactgagccgggcctcgccgcgacccttccggcccatctatcgggcaccggggctccggcccgggacccaggaccagcaacccgcgaccaatcatgctgcagcccaggggcgtctgctgtgccccgccaatcacgagactgggggaccggccgggcctggcaccaatctgcgctgcggtcgggcggagcttctgtttctcccagccaatcatgtgactcaaggaaaacttccggcgctgtgtccagtctcctccaatcaatggccttcgggggcgggccagcggccgct

SEQ ID NO: 749 - DNA, 2168 bp, Homo sapiens
ggctacgcagcttgctcctggcacgggcaccttgaatctcctcctcacacagatggagaccatgcttgatttcctgaacttgtagtaagaagaaggaaaacacagcacgctggagccaacagagttaagaggaagatttatgagtcatggaaccctccatcagatttggaagaaagtagaatgagcgcagaggtgacagacagccactgaggcccatggacaatctccacctcacgcttctctatcaaacttgaagatttattagtaatatgctgcctttggaagatgaaaacaaactagtgccaaggaggcgtattcttcaatatttggaatagacgtgttctcaagacaatggcttcaaaggtctcctgtttgtatgttttgacagttgtgtgctgggccagcgctctctggtacttgagtataactcgccctacttcttcttacactggctccaaaccattcagccacctaacagttgccaggaaaaacttcacctttggcaacataagaactcgacctatcaacccacattcttttgaatttcttatcaacgagcccaataaatgtgagaaaaacattccttttcttgttatcctcatcagcaccactcacaaggaatttgatgcccgtcaggcaatcagagagacgtggggggatgagaacaactttaaggggatcaagatagccaccctgttcctcctgggcaagaatgctgatcctgttctcaatcagatggtggagcaagagagccaaatcttccatgatatcatcgtggaggactttattgactcctaccataaccttaccctcaaaacattaatggggatgagatgggtggccactttttgttcaaaagccaagtatgtcatgaaaacagacagcgacatttttgtaaacatggacaatcttatttataaattactgaaaccctccaccaagccacgaagaaggtattttactggctatgtcattaatggaggaccgattcgggatgtccgcagtaaatggtatatgcccagggatttgtacccagacagtaactacccacctttctgttcggggactggctacatcttttcagccgatgtagctgaactcatttacaagacctcactccacacaaggctgcttcaccttgaagacgtatatgtgggactgtgtcttcgaaagctgggcatacatcctttccagaacagtggcttcaatcactggaaaatggcctacagtttgtgtaggtatcgccgagttatcactgtgcatcagatctctccagaagaaatgcacagaatctggaatgacatgtcaagcaagaaacatctcagatgttaggatttttaccaatgtaaatatgtttcttttctttttttaagaaatgggacctaaggtgttggtattttccaggtgtcgggggaaatgaactggtgaaggggttttgtaaagtttttgcttcctgctataagttcttttcttggattaccaatttatgaatgttagactctggtcatagaaacaataaatgagttagaagggccagatttcattctcagtcccagagcattgctatttatctcaaaaagtgacttccaaacaactcttaggattgacgtaccgtgcatctgagataaaaatttggttctgggaaactgaaactcacagtaatgtgtcatatcatccctgcaaaaattaatacacaaatagaaaccattttcaaaagcaattcagaaaggatgcacagtcaggaagacacactggatgtgattattaatatcgtgtgtgttgttacattatatttttacatatattcccatgtaatgtgtacagtctttgcagttccaccaagaaatgaacttggtacctgcagagtggctgcagttaaatagatgggagtttaaatttgagaatcaaacattctatgtgtttggaagacaactctgcttgctcatccaaggattaaatctggtcagcaggtggaatgtgtataaaatgctacttaacaaagtaaacaaaagattttttttttctttttttttctttcttttttgttttgctctttcagaacaaacattaaatggtgcctccaaggaaactttgccaaatataatctcacctgcttccttccagacagtgtcgctaagtgcatttcacagtttttggatctggcaggc

SEQ ID NO: 750 - DNA, 17695 bp, Homo sapiens
atgcagatggccaggctgctaggcctctgtgcctgggcacggaagtcggtgcggatggccagctccaggatgacccgccgggacccgctcacaaataaggtggccctggtaacggcctccaccgacgggtgagtgttggtgccggagtttctgaggccctggctgcctggaaacatgcactggtgtctcgtcctttgcctccagtgcccctgtcctcagacctcacataccgccaaagtctggccatggaaaaaaagtagccacgtggtccgcctgaagcccctccgaataccctggccctcccttgccagcccttctgtccctgctgcctctggcacaactgtgccacctctgtgcagccccatcgatctagtccccccagtgttctgggctgccccagtcaaccagccttacctagcctctgggaagaccagaaactggaaatgcaagggaatctggattcaaaatcttataacaaggcctccagctttttgaaaatgtaccattctatttgggctccagaaagtgtcccggaacccctcccccttacctagatgggacaccagagccatgtgtcgagacttttttttaggtcggtacatctgggcctaccttgcccagcctgtttctcacccacctctcttgtcagtcctggttctcatttctacaggactttgctagatgccagctcttcacaaaactaaaatacaaatgtagataaaatgctaatggctgacaactgcagaatgtgtaactcttcttcccaaggcaatatttacgtttttgaccagagaccatcttttcacatgcaccccaaaaaataattatggaaagaattttgagaatgatgtagactagtaagaaagaaacctggcggcaggactgttctgagtgagaccttcaaatcacggaagtggctgctgctgcacacccagctcatttctcacctctcagtcccaacaggagatgaagcctgtcacccgtggtgggaactgtagaaagtgatgtcagttcttgggaactaaggctgtgatccaggtcataataaaaataagtaaagcagtgctaaaaatggccatgccattaagcctgttttacacatagtaggcacacgtaggagttatatagagaaagagccagaattcaaacccgggcagtcttaacttcagagcccatgctgtcgacctcttcccctgcacaggccttagcagtctttgtctctttctgctcacaggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggtgagctgcagggaaatgggcacagagccaggaggtggaaaaggaagccagcctgagcctccttccctgctttcctagacagcagcacatttttactgtgtgcctttctattatgtccatatactaacgtcagagaatcatcccatctcagtcagagaattttaaaacattctaatgcttcaaccctgcatcatcccttgagtaccccaaagaaacagctggtactggttctgcagtaattttcaatctaattgaacagatgtgaagggtaaatacaatcacaaaatagatgttcccacccatgagctaataaacattcccctcttcttcagcttatagagtcaagtccctgggaacctcaggaagcagcccaccatgtttcagccacttactatgtgccatttcctgtgttcagagccttacacaggttatctctagacctgacaacaacccaagcaaggcaaggactattctctcagtctgcagaccctggctcagatagctggagcaacttcccaaggtcccacagccagtaaggaaagacccagacctcccaagctcccttcctttattggctgcctgtggactaccaggtactggacttcagtctcaaagaaagtacataagtcaatgtcataattagtagtggacaacagccttgcagctgctgaagcaactatgaagcattcacaaaggaagctcctcttcccttgaggctcagggcacacactttatttcccagagtggaagggagaatctacccaaaaatggaaagtacaggattctgctaacagattggaaggttggcagaaataatttgcataatcttcttagaagaggaggatcttaagcaatagtagacagaatagggtaattccatttttaaggaacagtctggcagacactcaaatgtgcattggaaagagccaaatatgagtccaagaaagtcacaaatgtgagtccaaaaaagcttggcttagactggtcgacaaagcccaagattggggccttgatcctgatggtggaaggagccgtttgggagtctggatcaattagcactaaccatacgacatgtaagtagcaatgtaatgtgaaaatcctcctagaaaaacaacctgtgccccccaccaggttcacttaacatggcctacaggcctggcccagaagtggtacttgagctaaaccttaaggaatggatgggaatggacagatggaatagtgacgaggttccagataactctgcaaaatgagcagacagccaaggaggaactgaaggaaagagaggagcactgtcagtccacagtggagagcacaggctcaggagtactgctggggaaggggctgcattggaaagatagaggccatgggcctccatatcttttttttttttttttgagacagagtttcattcttgttgcccaggctgaagtgatatggcacaatctcagctcactgcaacctacgcctccaggttcaagcaattctcatgcctcagcctcccgagtagctaggattacaggcatccaccaccacgtccagctaatttttgtatttttagtagagacggggtttcaccatgttggccaggctggtcttgaactcctgacctcaggtgatccaccccctcggcctctcaaagtgctgggattacaggcgtgagccactgtgcccggccatagcttcttaaaaggatacgttaaggaccttaaaaggatatggcctcttaaaaggatatgtttacacattcttgcagcaaataagaagccatgtgaggttttgagcaagagaaagatggttattaggaaagctaatctggctctggtaggaaggatatacagaggagacaccgaatccagggcatcagtgaggaagctgttgctgtcgtccaggtttagagcagtggcggcgggactggaatagatgtgcccaagagacatttagtggaaacgaaccaagattttccaaccccatgtcaaaaagtgggaaatagagaagtcaaaaatgactctcaggtagtttgtatgaccattgtcagagaagagaatgatagaatacttgtcagcaatttgaaatgtcttctgccagttgccacatgttaccctgcaataagaaaagccactgccctgagaatggatactacccagtggcctcctcatctgcacaccacgaagcttctcactggtgttgtaagtggaaaccagagtagctgcctatctgcttgattatattttttcttaaaaatgtataactatcagaacacagaacaaacagctcctaaccgctttagtgtagtgatcacacaatttagaataagacttagaagactttcttttatttttttccagagacagtgcctcattctgttgcccaggctgcagtgcagtgacatgatcatagctcactgtaacctcgaagtcctgaactcaagcaatcctcccacctcagcctcccaagtggctaaaactataggcatgcaccaccacaccagttcattttttaaattttttgtagagttggggctgtatttcccaggctgttttgaactcctggcctcaagtggtcctccccactgggcctaccaaagtgctaggattataggtgtgagccaccacacccagcctcattcatcttttatggtttgctgtctctgttcaatcaaaacccagcctcctcccatctctgtgctgacagacctggaaggagaggagtatggggtatacagcagagtagaaaatgtctccaggtgattctagagcaatccattgtctcctcccagcccaaacacatgtgtactgagcacagtgcacatcacttattaacttactctgcacctccctagtaacaagtccattggtgagacttacacagagccaacccaggtgacttggctttgtgccaggatgccaaaatttaaagggtgcaagaaagtattaataccgattttaaaagattatgtgactgtaaattttgttagattaacacgttgacaaacccagcattccttccactgtctagaaacaactgagcttagcacctagttaacaagaataattagttaaaacgggaagctagcagatggtgtacattgttagtaacacccctctctgtgccaaatccagagcacaaagttgaccaagggcccacatactgcaacttgcccaaggcatcaaaattgccagttccgggcaaatgcaaagtctagtttcagggtggctttgtactgaaaacccttgttggcagattctgcttggccattcattactctagcacacgcctcactatctacttataacttattaaggaggtgagatgttgcctttcttcgctttctcaatttaaatttcagtttctgccttgaatctttcatgcctccaggtcaaaagagagagacagagacagggaaaatgacatcataaccaaatatggaattgctttaaattcaggctggtatcttctcccatcatggctctcctgggcagctggtttactaatgaccccaactcactttcagaggtctcttatgaattagctctgtgctacaaagtgggagactgacctcacttcttccactactgactagctttgtgccctgaaaaaatcacttcacccctcccaaacacagaataagcaggcctcctgttcttagctagccccagtgtgccactactgaagtataagatcttgagaaaattctctgaacctgtttcatcatctccaccttaaggacactggaatagatgatctcaaaggcccctccagggtaactttcttcagctctatttaagccagtttttccattcaggtaagtgtggacagattgactttgagataatggtaacttattcagggagaactggacagtaagcacttggagaaatgtgggtggaactcagtgtgaaaggaagaggaggggtctggaaatagattttggggtgagacttgaaatcatgagaatgaaggagctttccaaagggaaagtgtaaagaaaagagcgtcagagacagccttggaagaataggaggtgggaagaaaagactgcaaaagaaatagggccaacttcctggtggcttgtgcctataacactttaggataccaaggcaggtggatggcttgagcccaggagttccagaccagcctgggcaacatggcaagaccctgtctctacaaaaaatacaaaaattgcccgggtgtggtggcacgcacttctactctcaactacttggggggctgagccaagaggatggcttgaacccagtaggtcaaggctgcagtgagctgagaacatgccactgtgctccagtctggatgacagagcaagactccatctaaaaaagaaagaagccaaccttaaatggttagcggcagatcttagggtagttttcaaaaaagatgttttaagaaatagaagttattttgacaatagttcttaagaatgaagcttttgttgtcattgttgttgttgtttttaatataaagataaggtctcgctgcatggcccaggcttctctcaaattcctcagctcaagtgagcctcccaccttggcctcccaaagtgctatgattacaggcatgagccacagctccttgcccagaaggaagtttttatcaacatgggtaaatgcacctcccttacttactgcagccctggtccagaccttacccctctctctaggctgtgaagcttcatggaggtatcgatatcctagtctccaatgctgctgtcaaccctttctttggaagcctaatggatgtcaccgaggaggtgtgggacaaggtgagaggggattaaagaagcgcggaagggggcctcgggacacattcagcacaaactccatctgcttttagaatgcatttctcaagggcagtgtaaatgtgaggactctttgccacgtgccacacacctggagcacaccttgcaaagggcaggtgggggtggctctttctctgcccttctcattcgtttctgctgctcctagttctctctgcttctatctgctcttcattagccactgctcccctccccaggcttcttccctggcatgctcttctgccttgttgatttccaacagagacgtaggcagctaatatgccaacaactacaacacttaatttacacacccacctgtcctcttttcagctgacaaaaactaatcattttttattagttgggaaatattaaatgctgctagttatttaaaatactaattctggtgaaatgaccagttgccactttataacatacatcctttaaaaaaataaaataaaaacctatgttattttcttcttaactgcaatgtcaagaaaatctgagatccagatgtctaaattcaagtggtagaatattgggttttatgtgaaagtgtataattacattatattcataatatatttcacacacaccctttaattacaaagctttaattaaaatatttgtctttgtttattaaggttaatattcccacatgattgggaaatgctaatttttatgatctcccatggttctgcgttttacactgatgttgtattagtctgttttgcattgctataaaggaatacctgagctgggcaatttataaagaaaagaagtgtgttttggcttacgatactgcagactgtacaagaagcatggtgccagtatctgcttctgatgaggcctcaggaagcttacaatcatggcagaaggaaaaagggagcaagtgtgtcacatggcaagacaggaagcaagagagagataccagtctcttttaaacaactagttctggcatgaaataatagagtgagaactcactcattgccacagggagggcaccaagccattcataagggatccaccctcatgacccaaacacctcacaccaggccccacctggaacactggtgatcacatttcaacatgggacttagaggggacaaacttaccaactatatcaggtgtcatcaaaatttctcaacactaaagtatcaggttgccaaaatactatgatttatttaccagtgtttcatacacataaagaccaaactgccaaaatgttcttcagtgagctagtttttgattctagtttgagctagtttgagagaaggctgggcaacacagcgagaccttttctctatattaaaaacaacaacaacaacaatgacaacaaaaccttccttcttaggaactatcatcaaaataacttctctttcttaaaccatcttttcttcaaaactacccagagatttgctgctaaccatttaagtttggcttctttctttctttttttagacagactcttgctctgtcttttttccttttttttttttttccccctcgctgtgtcattgaggctagagggctgtggtgtgatctcagctcactgcaacctcagcctcccaggttcaagcgattcttgtgcctcagcctcccaagtacctgggactacaggcatgtgccatcatgcctggctaattttttgtattgagatggggtttcactgtgttgctcaggctggtctcaaattcctggcctcaactgatccccacacctcagccccccaaaatattgggattacaggcatgagccaccacacacagccagattctgatagtctttaaaataaaggagcatcattcatgaacagtctgaatacagaccatatgaaagtcagttttaaactaagtacaggcacgcctcagagatattgtgggtctggttccaggccaccacacaataaagtgaatattataataaagtgagtcacatgaattttttggtttcccagtgcatataaaagttaggtttacattataatgatcatctaatggaagtctattaactgagcaatagcattatgttttaaaatatatatacgtatcttaattttaaaatactttattgctaaaaaaatgctgacaatcatctgagcctttacaacttgtaatctttttgctggtggaggatcttgcctcaacattgatggtggctgacttagggtggtgttgctgaaggctggggtggctgtggcagttttttcaaataagacagcagtgaagtttgccacatcagttgactcttcctttcacaagagatttctctgtagcatgcaatcctgtttgatagcatttacccacagtagaacttctttcaaaattggagtcaatcctatcaaactctaccactgcttactctactaagtacctataatattctgaatcccgtgttgtgatttcaacaatattcatggcatcttcaccagaaatagattccatcccaagaaaccactttctttgcttatccgtacgaaccagctcctcagccatctacattttatcgtgagattgtagcaattcagtcctatcttccagctccgcttctagttctcttgctatttccaccacatctgcagttccttcctctgatgcagtcttgaacccttccacgtcatccatgagggttggaatcaacttcttccagactcctgtaaatctagatattttgacctcctcccatgaatcacaaatattcttaatggcatctaaaatggtgcatcctttacagaaggttttcagttaactttgccaacatccatcagaggaatcactatccatggcagctatagccttacaaaatgtatttcttaaataataagtcttggaagtcagaattacccccgatccatgggctgcagaatggatgttgtgttagcaggcatgaaaacaacattaatctccttgtacatctccatcagagcttttgagtgaccaggtgcattgtcaatgagcagtaacagttttaaaggaatctttttctgagcagtagccatcaacggtgagcttaaaatattcagtaaaccatgctataaacagatgtgctgttattcaggctttgttgttccatttacagagcacaggcagagtagatttagcgtaaatcttgagagccctagaattttcagaatggtaaatgagcattggcttcaacttaaagtcactggctgcattagcccctaacaagagaataagcctgtcctttgaagttttgaagccaggcattgacttctcctctctagctattaaagccctacatggcatcttcttccactagaaggttgtttcatctacattgaaaatctgttgtttgctgtagccaccttcatcaatgatcttagctagatcttctggataactggctgcagcttctacatcagcactcgctgcttcatcttgcacttttatgttacagaggtggcttcttaaacctcatgaaccaaccactgctagcttccaacttttccggagcttcttcacttctctcagccttcaaagaattaaaaagttagggcctttttctgattaggctttggcttaagggaatgttgtggctagtttgatcttctgtccagaacataagaactttctctccatattaacaataaacctcttttgctttcttatcatttatatgttcagagaagtagcacttttaatttccttcaagaatttttcctttgcattcacaatttggctaactggtgcacatggtctaactttcagcctgcctcagctttcaacatgccttcctcactaagcttaattgtttctagcttttgatttaaagtgaaagatgtgtgactcttccttttgcttaaacacttacaagccattgtagggttaatagttggcctaatttcaatgtaaatgtgtctcagggaatatggaggtccacagagagggagagagatgagagaagggcagagcagtcagaacacacaacatttttcaattaagttgaccttcttttctgggtgtggtttgtggtaccccaaaacaattataataaaaccatgaaagatcactcatcacagatcaccgtaacagatataataataatggaaaggtctgaaatattccaagaattaccaaaatgtgacccagagacaaagtgagcacatgcaattggaaaaatggctcgaattaatgcagggttgccacgaaactccaatttgtaaaaaaaaaaaaaaaaaaaaaaaaaaaaaacaatatctgcaaagcataagaaaatatgtgtctataacttttcttttaatttgtatattttttaaactatcacagtatgtcaaatccaaacataatggctgatccttgattgaactctggactttaaaaaacacacacacacatttgggggataattgaggccaatatgttagataaaattatcatcattgtcaaactcttggttgtgataacagattatggttgtgtaaaagaaaatccttactctttggaaatgtatgctaagtatttggggatagaacattgtactatctgcaactgagtttacttattttattttaggttatttatttatttttgtgatggagcctcactctgttacccaggctggagtgcagtggtgctatctcagctcactgcaacctccacctcccgggttcaagctattctgctgtctcatcctcctgagtagcttggattacaaacacatgccaccacgtctggctaatttttgtatttttagtacagacgaggtttgccatgttgcccaggctgttctcgaactcctgacctaaaagtgatccacccatcttggcctcccgaagtgcagggattgcaggcatgagccaccatgcccagccctgagtttttttttttttaatttacatttttttatttttgttctttgtaatttttgattttattatataaaatctttcagaaaacttgcaactgagtttcaatggttcatttaaaaaactgtacagatctacagagaggacaaataggacaaaatgtgaacaattggtgactctaagtgaaggatatctagacattcattgtacttctatctccaatttttctgtaagattgaaatattttaatataagcagttgtctagaacagtgtaaacagggtcatacatttgttttagattatggatgtggggattctgattgtagcctgtcccccagcttccccagaaggtgactcctcatgatcccactttctaaccatgcctagccagacagtccttcctagagggccaagaacatctcactccctaagcccagaagccagagaagtgctagaacaaccccacatatccaaggtcaggccacattttccctgagaagcatggcctactctagggcaggtccaggaggctgacaattccaggctctacctacttggaagaaacagagaaaacacagctcaaatccaaaggccccttctggcccaaatcatacttggctgattatgaaacaagatgaaccaggctccatttttgctcacctgaacctaatgtatcattatctagctgagcagctggtgagagctacttctccctgaacctcagttccttcatgtgtaagatgcaggtatatcatcctaagatcttcgtcagctctgacaaacatcctaggaacccactctaactcctcattttttcatgcctcctccagtgctcttcactcatgctgtttccccttcttctcttggcttcagactctggacattaatgtgaaggccccagccctgatgacaaaggcagtggtgccagaaatggagaaacgagggtacagagagtgagagagagcctgggtgagaggggaccccacacaggctgagggcagtggtccacactgggaagacggtcagctctcttctttttccagaggcggctcagtggtgatcgtgtcttccatagcagccttcagtccatctcctgtaagaacccttttgtctacctcttccatcccaccctccactccacatctttccacccctcctattacccaaagaagtttgtgtccccttgtagaatcacaccaccaagtccctgcccacaaaatagatgccttgcctccacaaaccataacctaggggaggtttagccacaagacagtttcctaactctgcccctcccttacaggagatccctactgagcactgccctctatgtctagttattagaaccaagaatgacctggaaactatgagtctaacacattctcttctttctccagggcttcagtccttacaatgtcagtaaaacagccttgctgggcctcaacaataccctggccatagagctggccccaaggaacattagggtgaactgcctgcacctggacttatcaagactagcttcagcaggatggtgaggaaggggagctttgcatttgactgggaccccttgaaaggcatccatcttcttggacagggaagcccactacctgagtcctgagctctcagccactccattctccttccctggactttcccatattccctctctgtaccacctgccctatacaagccacactcttatcacaccttttctgaggtataggctggagactgaggtattcagactgtactcacactgtttcctccctccttacatggatgagaattggagagacgcagcaaaatgcatcactagaacctgaaacaaatgaaacagatgagggcagtggggagagctgggagctagaaaaaaataggaagtgaaagagggaagtctctcaccccatccctcctctcagttaccatgaggatgggcagtttcttccctttccattcttcactttcctcttcttttttttttttttttcttttttaattattattattattatactttaagttttagggtacatgtgcacattgtgcaggttagttacatatgtatacatgtgccatgctggtgcgctgcacccactaacgtgtcatctagcattagatatatctcccaatgctatccctccccactcccccgaccccaccacagtccccagagtgtgatattccccttcctgtgtccatgtgatctcattgttcaattcccacctatgagtgagaatatgtggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtattttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgcggtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtggatatgcggcattatttctgagggttctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgattcctcttcttaaacataaagagatttctgggtggggtggctcatgcctgtaatcccagcacattgggaggccgaggcgggcagatcacgaggtcaggaggtcgagaccatcttggctaacacggtgaaaccccgtctctactaaaaatacaaaaaattagccgggcgcagtggcgggcgcctgtaatcccagctactcgggaggctgaggcaggagaatggcataacccgggaggcggagtttgcagtgagccaagatagcgccactacagtccggcctgggcaaaagagcaagactccgtctctaaaaaaaaaaaaaaaaaaagaaaggaaaagaaaaaaaaacataaagagatttcccttcttcctacagctctggatggacaaggaaaaagaggaaagcatgaaagaaaccctgcggataagaaggtaaactgtcatgagggcaagggcactaagagacatgaagatgggaaggtctggtccctagcagcccacagcccgctgtctcagtcccacagataacacaggcaggctctcttctgcctcacagaccacgaattcataaacactatcactacagtgacctgagcaagaagtcagcttccctttccaaaggtaaacacagagacatcggggtttcagcagtgcagaggtctcggagaagccctgagtcctctctccacctgggggattgcctccacctctgagcatccatggagaccagggaccataaccaaaaccatgctttgttagtccccttgaataatgacacatgtttacaaaactcaggttgatgatctacaatccaaatgaaaagaatgaagagttttactaagccccaaactccccttgcctaaggagttactttcttccccagtgagctgggtgaactgttcaagcacctttgtcgggctccctttcctctaagttccctgcctctctctaccttctggcttcaaggacaaatgccagtaatgcctaactctgtactcgtccagacatcccaaatcttcccaaagccattctgatgtgagacatgagctgcaggcctggttcataactcattaataagtgaggggattgtcaacctagagcaccaatgaatgatctagcccatgtagctcaatactggattcacattagaatcacctggggagctttttaaactgcaggtgctcaggccccacccactcccagagattctttttaattggtccaaggtaggacttgaccatctgggcttttgtttttctttgtcttttcttttcttttcttttttggtttaagcctctcaaatgattgcaagatacaagtagaatggagaagcattaattcagcccttctaggtttgagttactcactctgcccacctctagagcattctatggcagggagattaaagtgtctcctaactatgcagtcactgataaaataagaattagcacattctcactaaatgaacatgactttaaggcacaagtatagattcctgaaaaagttctaagctgaacctgtacaaatggaatcattttaaacacaccatttactgtcacacagactccctgatactttagtgtgtgcacatgtgaaaccatttttttgaagtatgaaataattaattgctcaccattttatctatataactttggattttggtgtcctgagctctctaaaaaccggtgtgtttctatagtatttgaatattatgggtaatagttttgcagagtacagtatgcttatactaaattataacagcatatcctcgtggtaaccctatttgataggcagaaagcttgtacactgatcctgaaaagtcatctgataattcttgattaagcaaatttaactccccgtgtcccaggtgagggaggcagacccgtttgatttttacctccttccttgcttcccttattccccaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgcaaatgaggtgcaaataaaatgcagatgattgcgcggctttgaatccaattgacctgttcatttctcagtgttgggtgcttagctgagcagagagcagaagtctattcaggctggatctctggatcccccagccctcctccctgtctccagaacttgagcgtgatgttcacgggtggaggtgtctgcagagctgccagctggaaggaaggtggcacgggaactcccaggacgccacgggaatccccgaggcagcgcgagcccggagagagtggggaaggatga

SEQ ID NO: 751 - DNA, 1289 bp, Homo sapiens
gaagagtggaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccacggctgtgaagcttcatggaggtatcgatatcctagtctccaatgctgctgtcaaccctttctttggaagcataatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcatcaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcggctttgaatccaaaaaaaaaaaaa

SEQ ID NO: 752 - DNA, 1289 bp, Homo sapiens
gctggaaggagtggaacccagacttgctggtctgatccatgcacatggccaggctgctaggcctctgtgcctgggcacggaagtcggtgcggttggccagctccaggatgacccgccgggacccgctcacaaataaggtggccctggtaacggcctccaccgacgggatcggcttcgccatcgcccggcgtttggcccaggacagggcccacgtggtcgtcagcagccggaagcagcagaatgtggaccaggcggtggccacgctgcagggggaggggctgagcgtgacgggcactgtgtgccatgtggggaaggcggaggaccgggagcggctggtggccatggctgtgaagcttcatggaggtatcgatatcctagtctccaatgctgctgtcaaccctttctttggaagcctaatggatgtcaccgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctcaacaataccctggccatagagctggccccaaggaacattagggtgaactgcctgcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcccgcattcacccactggcctttcccacctctgctcaccttactgttcacctcataaaatcagttctgccctgtgaaaagatccagccttccctgccgtcaaggtggcgtcttactcgggatttctgctgttgttgtggccttgggtaaaggcctcccctgagaacacaggacaggcctgctgacaaggctgagtctaccttggcaaagaccaagatattttttcccgggccactggggaatctgaggggtgatgggagagaaggaacctggagtggaaggagcagagttgcaaattaacaacttgcaaatgaggtgcaaataaaatgcagatgattgcgcgaaaaaaaaaaaaaaaaaaaa

SEQ ID NO: 753 - DNA, 483 bp, Homo sapiens
atggtcaaccccaccgtgttctttgacacggagcccttgggccgcatctcctttgagctgtttgcagacaagtttccaaagacagcaggaaactttcatgctctgagcactggagagaaaggatttggctataagggttcctgctttcacagaattgttccagggtttatgtgtcagggtggagacttcacatgccatgatggcactggtggcaagtccatctacagggagaaatttgatgacaagaacttcatccggaagcatacagtttctggcatcttgtccatggcaaatgctggacccaacgcaaacagttcccagtttttcatctgtgctgccaagactgagtggttggatggcaagcatgtggtcttcagcaaggtgaaagaaggcatgaatattgtggagaccatggagtgctttgggtccaggaatggcaagaccagtaagaagatcaccattgctgactgtgggcaactctaa

SEQ ID NO: 754 - DNA, 749 bp, Homo sapiens
gctttgcagacgccgccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacaggtcctggcatcttgtccatggcaaatgctggacccaacacaaatggatcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccaggtcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaaa

SEQ ID NO: 755 - DNA, 1707 bp, Homo sapiens
aggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcat

SEQ ID NO: 756 - DNA, 1848 bp, Homo sapiens
atggactcaacacaggccgtgcagactccggcggagcctgggcttcatctgggacagactgactgtgtggacagctgtgaggctgttatgccatcactagagctggctgtcagtaaatacacgttgggcacatgtggcaatcagtgcccttcagtgtgccagaagaaggtaagcatctgccacatggcgccggcagaggaggggaggaagagagacgctgagagctggggccgtcctcgcaggtggaggcctgcgtgtggtctggcccacaggagcgtgtccaccatggtggggaggggtgggaaatcaagcaaccaaggctatagaatagcattgagaacagaagcaactagattggaggggaaaaaattctattctctgactgcggcaataacctttcttttaaatggacatgagtgtccctttgtgtgtttaatggcacatgcatgtgctccactgatctacatggccctggaagaccacagcagcatccccagaacaaagtcgcactacagcgtgttcttcctgagtgtgtgcagggaggaggatgaacacgaggatcctggaggtaccaggtccatccagcccctgctcctcaggaggtcactgagagttgaaacaggaaaactgatagaaaggaaaagttccataagagtgccagacaagatagagaatgaaaaacccctgctctgtggaccctccaggcctggctccattcagtcaaaacagcgtacggctgtctccagggccagagttttcggcatccatttgagtttgtgcagtgtgaatgcctgctcagtccaaatgagctttgagagcaaaagccttgatctcttggagactcgatgttctcccttgggagatgacaacagtggctggtggtttctgcttagtgggctgaggggagcatttccaggagtgggatgtctaagccaggacttaaaggaagggaagtgcacacagatcctcacagcaagggtgcaggtgctaaagcaggaggtgtgttctggagcccctagtgggttggcaaagctgcctgtgcactcagggcctgcggaagagatggaaagctgcaccctaagtgggaggaaaatgcagaccatccctacagatgcttggactcctctttccatggccacatccagaaccactccttctctgcagggaccagtcatgtttgcactcaaaattaaatccaagtactattttccagagaaagaactcaatctgcctggagaagagcgctcctataaaagccgtggcttgtcagagaggccagagcagagcctgagtaacaccagctccccagcctttgtagatgccgctgccaccaggagccctgtactatcagccacggtcaaccccaccgtgttcttcaacattgccattgacagcgagcccttgggccacgtctccttcaagctgtttgcagacaagtttccaaagacagcagaaaacttttgtgctctgagcactggagagaaagcatttggttataagggttcctgctttcacagaattattccagggtttatgtattagggtggtgacttcacacaccataacagcactggtggcaagtccatctatggggagaaatttgatgatgaaaacttcatcctaaagcatacaggtcatggcatcttgtccatggcaaatgctggacccagcacaaatggttcccagtttttcatctgcactgccaagagtgagtggttggatggcaagcaagtggtctttggcaagatgaaagaaggcatgaatattgtggaggccacatagcgctttgggtccaggaatggcaagaccagcaagaagatcaccattgctgactatggacatctctaa

SEQ ID NO: 757 - DNA, 1005 bp, Homo sapiens
gcgtcaaccaccacacctggcctgtcacttctttatcatgttaattttcatctaaaaaaactatcactgaaaactttttcctttcaaagtactgaacagttttcttctcttgctaatttcttttttgctactaaagacttgtgtttctagagatatgaccgtaattattccaacctctccaatttataatttagtgttcaagcttttaaattaaggaacactatgtttgacagctgctgattaagaaatcacacttctgtaattatcaaaaacaatttaccttggtctgtcacagtattttttttttttttttaagagaaacacccgtcaaatttattgcagttgtccagtcagcaatggtgatcttcttgctgattgctgatcttgccattcttggaccccaagtgctccatgacctccacaatattcatgccatctttcaccttgccaaagaccacatgcttgcaatccaaccactctgtcttggcatcttggcagggcagataaaaaactgggaaacgttcacgctgggtccagcatttgccatggacaagatgccaggacccgtatgcttcaggatgaagttcttgtcatcaaatttctccctgcagatggacttgccaccaatgctgtatggcgtgtgaagtcaccactctgacactctccagtgctcagagcatggaaattttctgctgtctttggaaccttgtctgcaaacagctccaatctgttaacatagttttatggattagatgagcagtcacttcttgctttccaggccccttacctcgaaggagacacagcccaagggctcgccatcgacagcaatgtggaaaaacatggtggggttgaccatggctggaagcagggggccctgggcggcagcagcatctgcaaagctcacagccttctttttaaaagtcagcttcattagctactgggaagaatgactagttaaaacattttcccctagcatttctttctttcttttttctttttgagatg

SEQ ID NO: 758 - DNA, 773 bp, Homo sapiens
ggtgcgacgctgctgccgaggaaaaccttgtattattaggcatggtcaaccccaccgtgttcttcgacattgccatcgacggcgagcccttgggccgcgtctccttttagctgtttgcagacaagttcccaaagacagcagaaaattttcgtgctctgagcactggagagaaaggatttagttataagggttcctgctttcacagaattattccagggtttatgtatcagggtcgtgacttcacacgccataatggcactggtggcaagtccatctatggggagaaatttgaagatgagaacttcatcctaaagcatacaggtcctggcatcttgtccatggcaaatgctggacccaacacaaatggttcccagtttttcatctgcactgccaagactgagtggttggatggcaagcatgtggtctttggcaaagtgaaagaaggcatgaatattatggaggccatggagcgctttgggtccaggaatggcaagaccagcaagaagatcaccattgctgactgtggacaactcgaataagtttgacttgtgttttatcttaaccaccagaccattccttctgtagttcaggagaacacccttccaccccatttgctcgcagtatcctagaatctttgtgctcttgctgcagttccatgttttccttgttccctcccatgcctagctggattgcagagttaagtttatgattatgaaataaaaaccaaataacaaaaaaacaagaaaagaaaaaaaaaaaaaaaaaaaaaaaaa

SEQ ID NO: 759 - DNA, 1796 bp, Homo sapiens
ggccaggctcgtgccgttttgcagacgccaccgccgaggaaaaccgtgtactattagccatggtcaaccccaccgtgttcttcgacattgccgtcgacggcgagcccttgggccgcgtctcctttgaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcat

SEQ ID NO: 760 - DNA, 1011 bp, Homo sapiens
atgggctgggagagttacaacagaagaaggcatccttcgaaggagaatgacctagagcaaggggcacagaggctacgaaagaccctgctcctggtgccatgtggccgcctcacagaccagcgtttacagttcaccatccacccacccaccttccgcctgcaacacaggagagggtccaggtccctccccctgggaacactgatgtcgctctacagaccaagagagggccagaggggctctgccaaggcccccttcctggcatgccagccgattgcccccagaaacagggcctccatttccttttgcctcccccagtacttcatccgaggctttgcaccagggcccctggaagccccaggcccatggtcccaaggaaatcctttggttctctcctcggtggcccatggcggccctgagccggccaagccagctccaggaagtgggaaccaggccctgaacaagaagacagctgggcccaaagaggacactgccaccgccgggagccccgtactatcagccatggtcaaccccactgtgttcattgatggtgagtccttgggccacgtctccttcaagctgtctgcagacaagtttccaaagacagcagaaaactttcgtgctatgagcactggagagaaaggatttggttataagggttcctgctttcacagaattattccagggtttatgtgtcggggtggtgacttcacgcaccataatggcactggtggcaagtccgtccaccaggagaaatttgatgatgagaacttcatcctaaaacatacaggtcctggcatcttgtccacggcaaatgctggacccaacacaaattgttcctggtttttcatctccattgcgaagactgagagtttggatggccagcacgtggtctttggcaatatgaaagaaggcatgaatgttgtggaggccatggagccctttgggttcaggaatggcaagaccagcaagaagatcaccattgctgactgtggacaactccaacaaatttga

SEQ ID NO: 761 - DNA, 660 bp, Homo sapiens
actataaagacagtaaaaagatcagtggttatctttgcagatgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatc

SEQ ID NO: 762 - DNA, 965 bp, Homo sapiens
atggcaaatgctggacccatcacaaacagttcccagtttttcatctgcactgccaagactcagtggttgcatggcaaggatgtggtctttggcaaggtgaaagaaggcatgaatattgtggaggccatgaagcgctttgggtccagtggcaagaccagcaagaagatcaccattgctgactgcagcaaaatcatattagcagccccaaaacccaataaggaccatgtacccagtcaaaacttctcaacacaaaaggagacaacttccgcattcatcccccagttaaggtcctcatctcacgggactattggaatcatctccttcctgtgtggccccccgcgaagcccttctcagcagccagctggggtatttagaacgttggtgctcccgattagagagaccttgattctccccggggcccaggaaatggatccccccggcaaccgcacagctgcctcggactctgacttaattccctccgcgtgctctgaatcgcagagaggcaaacccccaaacaaagagccggcagctcgcgtgcggggctcccgggcgcgtcctgccggctgggctgggagagccggcgccggggcgtcgcggccgagcgctgggcaggcggggactagagggccggcaggaagcctcagtgggcgcaggggcgcgggccgggctgcccacacgctgaccttcccgggctgggagggaggagcgctggctgcgggcggtgggcggctgggcggccccgggagccgccgctctcagtctctctaggcgcagctcccttcgccgcttccggagcccctggcagggcccagaagccatggcccactataagactgagcaggacgactggctgatcatctacttgaagtatttactctttgtcttcaacttcttcttctgggtgagtgaattctgcacacacatcctcttccccgagcactgaatgagtcaagccaccttttgtt

SEQ ID NO: 763 - DNA, 965 bp, Homo sapiens; identical to SEQ ID NO: 762

SEQ ID NO: 764 - DNA, 3729 bp, Homo sapiens
tgccacttcactccagcctgggtgacagagcaagactctgtctcaaaaaaaacaaaaaaaagaagaagaaagaaagaaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggatggcagagttgagttaagtttatgattatgaaataaaaactaagtaacaacaacaacaacaaaaaagctcagtggttgccaggagtttggggatgggtagggagataaacagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagcctttacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagtgagactttgtttcaaaataaaaaaataaaaataaaaaaataaaaatgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatacttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaataaataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctc

SEQ ID NO: 765 - DNA, 492 bp, Homo sapiens
atggttaaccccaccgtgttcgacatcgctgtcgacggcaagcccttgggccgcgtgtccttcgagccgtttgcagacaaggttccaaaggcagcagaaaactttcgtgctctgagcaatgtagagaaaggatttggttataaaggttcctgctttcacagaattattccagggtttatgtgtcagggtggtgacttcacatgccataatggcactggtggcaagtacacctgcggggagaaatttgatgacgagagcttcgtcctaaagcatacacatcctggcatcttgtccatggcaaatgctggacccaacacaaatggttcccagtgtttcatctgcactgccaagactgagtggctggatggcaatcctgtggtctttggcaaggtgaaagaaggcatgaatattgtggaggccatggggcactttgggtccgagaatggcaagaccagcaagaagatcaccattgctgactgtggacaactctaa

SEQ ID NO: 766 - DNA, 495 bp, Homo sapiens
atggcaaaaattcaagatctgaagaaacacctggaagataccctaaacaaaatcaaaaacgccgatgcctcccagagccctctgccaccagccatagtcaaccccatcatgttcttcaacatcgccatcatcagcgagcttttaagcagaatctccttggagctaattattccagggtttatgtgtcaggctggtgacttcacaaaccataatggcactggcagcaagtcactctatggggagaaatttgatcatgagaacttcattctgaagcatacaggtcctggcatcttgtccatggcaaatgttggactcaacacaaatagctctcagtttttcatctgcactgccaagactgagtggttggatggcaagcatgtggtctttggcaaggtgaaagaaggcatgagtatcatggaggccatggagcgctttgggtccaggaatggcaagaccagcaagaagatcaccattgctgactgtggacaactctaa

SEQ ID NO: 767 - DNA, 1652 bp, Homo sapiens
aaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcat

SEQ ID NO: 768 - DNA, 749 bp, Homo sapiens; identical to SEQ ID NO: 754

SEQ ID NO: 769 - DNA, 1707 bp, Homo sapiens; identical to SEQ ID NO: 755

SEQ ID NO: 770 - DNA, 1848 bp, Homo sapiens; identical to SEQ ID NO: 756

SEQ ID NO: 771 - DNA, 744 bp, Homo sapiens
atgaggaagtgggtagggggccttccctgcccacacgtggccgtgacctccgcagagggctgcaggaaggagctcaatgcggaaccgcgaaggctgctgcagccctcagatctaacgcctttgacgcgttggagcttgtcagcgataaaacctgacctagaacttactgtggctgctgtttaccctctagttgggctctactgcgaggcaaggcaaaagtcaggtccgtcggcgccctctcctggtaaagctgcgaagctgcagcaaacagagctaaattggtattttcccccagtccttgggcctcatctttttcaagctgtttgcagacaaatttccaaaaacaacgaaaactttcatgctctgagcactgtagagaaaggatttggttataagggttcctgctttcacagaattatttcagagtttatgtgtcagggtggtgacttcccatgccataatggcactgatggcaagttcatctacggggagaaatttgatgatgagaacttcattctgaagcatacaggtcctggcatcttgtccatagcaaatgctagacccaactcaaacggttctcagtttttcatctgcactgccaagactgagtggttggatggcaagcatgtggtctttggcaaggtgaaagaaggcatgaatattgtggaggccatggaccgctctgggtccaggaatggcaagaccaacaagaagattatcattgctgactgtgggcaactctaa

SEQ ID NO: 772 - DNA, 1796 bp, Homo sapiens; identical to SEQ ID NO: 759

SEQ ID NO: 773 - DNA, 965 bp, Homo sapiens; identical to SEQ ID NO: 762

SEQ ID NO: 774 - DNA, 819 bp, Homo sapiens
atggtcaaccccactgtgttcttcgacatcagtgtcagtggcaagcccttgggccatgtctccttcaggatatttgcagacaagctttcaaagacagcacaaaactttcgtgctctgagcactggagagaaaggacttgattataagggttcctgctttcacagaattattccagggtttatgtgtcagggtggtgacttcacgtacaataatggcactggtggcaagtccctctatggggagaaatttgatgatgagaacttcatcctgaagcgtatacgtcctggcatcttgtccatggcaaaagctggacccaacacgaatggctcccagtttttcatctgcactgccaagactgagtggttgattggcaagcatgtggtctttggcaaggtgaaagagggcatgaatattgtggaggccatggagccctttgggtccaggaatggcaagaccagcaagaagatcaccattgctgattgtggacaactctggattctggctgacccctccatcgatgacctgcttctgctggctgtgtccagggtggcctccctgaagccaccggagcagaggcctggtatcttctcagagcagcagccaaccaggcagctggaggaaacccctggtctcttttgcagccaagcctccctgctctcgtcctcagggcacttctcaccccctccatccctgctgacgctgagtgctatcacccccaaggaaggacgcttcctggaatgcccagcctgccacccaagagactcccctcagggcacccactgctggatccaacaggtctgccccagtgccagcccctag

SEQ ID NO: 775 - DNA, 492 bp, Homo sapiens; identical to SEQ ID NO: 765

SEQ ID NO: 776 - DNA, 1652 bp, Homo sapiens; identical to SEQ ID NO: 767

SEQ ID NO: 777 - DNA, 1824 bp, Homo sapiens
cagggcgcgggcgcccgccctgctctgtgacgcgcggcccgaggcgcacgcagggctcacaccacctgtcctggcctccgacccgggccgactatggcggcgctgcggctcctggcgtcagtgctcgggcgcggggtccccgccggcggctcagggctcgcgctgtcccagggctgcgcccgctgctttgccaccagtccccggctccgtgccaagttctacgcggacccggtggagatggtgaaggacatctctgacggggcgaccgtcatgatcgggggcttcgggctctgcgggatccccgagaacctgatcgccgcgctgctcaggacccgcgtgaaagacctgcaggtggtcagcagcaacgtgggcgtggaggacttcggcctgggcctcctgctggccgccaggcaggtccgtcgcatcgtctgttcctacgtgggcgagaacaccctgtgcgagagccagtacctggcaggagagctggagctggagctcacgccccagggcaccctggccgagcgcatccgcgcggggggcgccggggtgcccgccttctacacccccacgggctacgggaccctggtccaggaagggggcgcccccatccgctacaccccggacggccacctggcgctcatgagccagccccgagaggtgagggagttcaacggcgaccacttccttttggagcgcgccatccgggcagacttcgccctggtgaaagggtggaaggccgaccgggcaggaaacgtggtcttcaggagaagcgcccgcaatttcaacgtgcccatgtgcaaagctgcagacgtcacggcggtggaggtggaagagatcgtggaggtgggggctttccccccagaagacatccacgttcctaacatttatgtagatcgcgtgataaaggggcagaaatacgagaaacgaattgagcgcttaacgatcctgaaagaggaagatggagacgctggaaaggaagaggacgccaggacgcgcatcatcagacgcgcagctctggaatttgaggacggcatgtacgccaatctgggcataggcatccccctgctggccagcaacttcatcagtcccagcatgactgtccatcttcacagtgagaacgggatcctgggcctgggcccgtttcccacggaagatgaggtggatgccgacctcatcaatgcaggcaagcagacggtcacggtgcttcccgggggctgcttcttcgccagcgacgactccttcgccatgatccgagggggacacatccaactaaccatgcttggagccatgcaggtttccaaatacggcgacctggcgaactggatgatccctggcaagaaggtgaaaggcatgggcggtgccatggacttggtgtccagtcagaagaccagagtggtggtcaccatgcagcactgcacaaaggacaacacccccaagatcatggagaaatgcaccatgccgctgaccgggaagcggtgcgtggaccgcatcatcaccgagaaggccgtgtttgacgtgcacaggaagaaagagctgacgctgagggagctctgggagggcctgacggtggacgacatcaaaaagagcacggggtgtgcctttgctgtgtccccgaacctcaggcccatgcagcaggtggcaccctgacgggacctggatctgggcggggtggtgcgctcctcagggcgggtgccaccgggttccccaggggaatacatgtccccagctctgggaggggtttgctactggcctcctactttcctccctaggtggacagtgctcctctagagagctgcgactttaattaaaaacaacaggaaaaca

SEQ ID NO: 778 - DNA, 1908 bp, Homo sapiens
aaagaaacccgagacgttccgaagtcaacgcaagcaaaggggagtgcgggtcggggaggaatattcttttggaaacgtaatattggccttggggctctccagccctttgggacttccaatgggatcttagaagcagccgaagcagcgtgagggcggcagcccagggccagccacgatttgaacgctctgccttgcagctcttctggaccgaggagcccaaagccctaccctcaccattcaccaggtcctgtgggaagagcagcgtggaggtgggctgaggttagaaggtgcagagcgtggaagaagattgtgagctgagtattggacatctgttcttgaatagtccctgggcctgccataggaaaggaagttctccagggttacagttcttatccgcgtgaatacacatggctctgttacgaaaaattaatcaggtgctgctgttccttctgatcgtgaccctctgtgtgattctgtataagaaagttcataaggggactgtgcccaagaatgacgcagatgatgaatccgagactcctgaagaactggaagaagagattcctgtggtgatttgtgctgcagcagggaggatgggtgccactatggctgccatcaatagcatctacagcaacactgacgccaacatcttgttctatgtagtgggactccggaatactctgactcgaatacgaaaatggattgaacattccaaactgagagaaataaactttaaaatcgtggaattcaacccgatggtcctcaaagggaagatcagaccagactcatcgaggcctgaattgctccagcctctgaactttgttcgattttatctccctctacttatccaccaacacgagaaagtcatctatttggacgatgatgtaattgtacaaggtgatatccaagaactgtatgacaccaccttggccctgggccacgcggcggctttctcagatgactgcgatttgccctctgctcaggacataaacagactcgtgggacttcagaacacatatatgggctatctggactaccggaagaaggccatcaaggaccttggcatcagccccagcacctgctctttcaatcctggtgtgattgttgccaacatgacagaatggaagcaccagcgcatcaccaagcaattggagaaatggatgcaaaagaatgtggaggaaaacctctatagcagctccctgggaggaggggtggccacctccccaatgctgattgtgtttcatgggaaatattccacaattaaccccctgtggcacataaggcacctgggctggaatccagatgccagatattcggagcattttctgcaggaagctaaattactccactggaatggaagacataaaccttgggacttccctagtgttcacaacgacttatgggaaagctggtttgttcctgaccctgcagggatatttaaactcaatcaccatagctgatataactctacccttaaaatattccctgtatagaaatgtggaattgtccctttgtagccaactataacattgttctttatgaatattacctttgatacatatgatccacaatataaaaaccaaaaactactgtgtgcaaattataccttggaccatataggcattgattaacttctttaagtacatgtgataactatggaaatcaagattatgtgactgaaaaacataaaggaagagacccatctagataacagcaatcaacctgcttaattctgaatgacaattatatccacaaatttttaaaacttctacatgtatttttcacatgaagatctccttaacaggttgccaaccttttcttttataaaactattacatttaaaatatggacgtctgaaaaataaaatattcatcatttttacaaaaaaaaaaaaaaaaaaaaaaaaaaaaa

SEQ ID NO: 779 - DNA, 2702 bp, Homo sapiens
ggctcggggcgccgaggcttccgcgcccgctggttcctcgctccggggcggagctcgcgatagcgaccgggagcagggcgcggggcgggacccaggtccgaggcgaggaagccggaagccaggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacgaaaaaaaaaaaaaaaaaa

SEQ ID NO: 780 - DNA, 756 bp, Homo sapiens
atgggtggaagcaccagccagcagaggaaggggcgctcctgccagattgccatggagggaggtgtccgcctgaggcctcctgtcccgcggggtatgaggatgcttggggagcatctctggcgccatggcaaatgcgcctctttcaacgggatttccggacgcgctgctttggatgtcgggttccactgcaccagcaaggctgagaatagaaagtttttcacaaatgacaatcccatcaccatcttccaggagaaagattccaccaaaatcaaatacaatgatattagacaccgattatgttgtggagtcaaagggaatcttcactggcatggagacatctggggttcacatagatggaaacaagttctcagaccccaggtgaaggttatccatgataaatgtagcatcatggagaaaatcatgaccacagtcctttacatcactgccacccagaataccatgaatggtccctctgcaatcagtctatcagttactggcctgacatggcatcaggataaacctgcaaaatatgacagcataaaaaagacagtgaagcaagcactagataaaactttcaagggcatcctaggcttcactgaagaacaagttgtctcctctgactttaatgctaagttcttggtaaacaataaatttgactacagcaacaaggtggtcaaccttattgttcacattggcctccatgaattaaagagccctgtcaccactggcagtagagagcataagagaaagagatag

SEQ ID NO: 781 - DNA, 1128 bp, Homo sapiens
atggttgataacattacagaagaaaaggctgatgtgattgcatcagcccttgcccagatcccacaaaatattaaatacaaccctgatgtttttaaagaaatgatgacattcattaacacagggaaagaactaaaccttgacaaaatgacggacaacttgttggcagctgcagacaaacatgcactgggaacagctaaagatttgcatgttgcagaacagttgaaagcacaaaccatagacattattaataggtgcagtgtacttcgacaacttcgctgtaaagataagaaaaactggaatgtcaacgaagcaaccaacataatggaaacatcaagactcaccacaaataattattcaaaaatttatgtaatcctaggtcatctaaaaaccaaagcttttatacctcatggtggagccaatggcacctatgagaggatctaccatgggatccctgtgacaattgtcaataaaccactcagtaaagagaatgttatatggttatcggtcattcattatgatcagcttatgaagcccatggaccaaaaagtcttctggatcaagtttgtcatgcgccacagaggagccaagtacttgccgccacctgcgaaaaacctcatctgctatgaagagaatgctttgaaattatcaaggattcatcatgatcagccaacgaagccccgggatcaagcggtcttctggattgagtttgtcatgcgccacaaaggagccaagcaccttcgggttgcagcccgtgacctcacctggtttcagtaccactctttggatgtgattgggttcctgctggccttaaccgcaggtaaaaggaaattctctcacagtggtatcattttggtgtgtggaaggggggtggtacagtccaaaataattattcatcttaccaatcataagtttttcatgtccgaaatggaagaatttgtccagagctctgatgaggatggtgttgttgtgttttctctggagtcagttgtgcaaaaccttacagaagaaaaggttgatcttatcacttcaggcctggctcagattccacaaaaagtcagtagaacctccaatccttataagaagctattcacacaatggagaaagtatggctttccatttggaatttga

SEQ ID NO: 782 - DNA, 4366 bp, Homo sapiens
tgcattctttgccccaaaactctttcctttggttgtgctaagaggtgatgcccaaggtgcaccacctttcaagaactggatcatgaacaactttatcctcctggaagaacagctcatcaagaaatcccaacaaaagagaagaacttctccctcgaactttaaagtccgcttctttgtgttaaccaaagccagcctggcatactttgaagatcgtcatgggaagaagcgcacgctgaaggggtccattgagctctcccgaatcaaatgtgttgagattgtgaaaagtgacatcagcatcccatgccactataaatacccgtttcaggtggtgcatgacaactacctcctatatgtgtttgctccagatcgtgagagccggcagcgctgggtgctggcccttaaagaagaaacgaggaataataacagtttggtgcctaaatatcatcctaatttctggatggatgggaagtggaggtgctgttctcagctggagaagcttgcaacaggctgtgcccaatatgatccaaccaagaatgcttcaaagaagcctcttcctcctactcctgaagacaacaggcgaccactttgggaacctgaagaaactgtggtcattgccttatatgactaccaaaccaatgatcctcaggaactcgcactgcggcgcaacgaagagtactgcctgctggacagttctgagattcactggtggagagtccaggacaggaatgggcatgaaggatatgtaccaagcagttatctggtggaaaaatctccaaataatctggaaacctatgagtggtacaataagagtatcagccgagacaaagctgaaaaacttcttttggacacaggcaaagaaggagccttcatggtaagggattccaggactgcaggaacatacaccgtgtctgttttcaccaaggctgttgtaagtgagaacaatccctgtataaagcattatcacatcaaggaaacaaatgacaatcctaagcgatactatgtggctgaaaagtatgtgttcgattccatccctcttctcatcaactatcaccaacataatggaggaggcctggtgactcgactccggtatccagtttgttttgggaggcagaaagccccagttacagcagggctgagatacgggaaatgggtgatcgacccctcagagctcacttttgtgcaagagattggcagtgggcaatttgggttggtgcatctgggctactggctcaacaaggacaaggtggctatcaaaaccattcgggaaggggctatgtcagaagaggacttcatagaggaggctgaagtaatgatgaaactctctcatcccaaactggtgcagctgtatggggtgtgcctggagcaggcccccatctgcctggtgtttgagttcatggagcacggctgcctgtcagattatctacgcacccagcggggactttttgctgcagagaccctgctgggcatgtgtctggatgtgtgtgagggcatggcctacctggaagaggcatgtgtcatccacagagacttggctgccagaaattgtttggtgggagaaaaccaagtcatcaaggtgtctgactttgggatgacaaggttcgttctggatgatcagtacaccagttccacaggcaccaaattcccggtgaagtgggcatccccagaggttttctctttcagtcgctatagcagcaagtccgatgtgtggtcatttggtgtgctgatgtgggaagttttcagtgaaggcaaaatcccgtatgaaaaccgaagcaactcagaggtggtggaagacatcagtaccggatttcggttgtacaagccccggctggcctccacacacgtctaccagattatgaatcactgctggaaagagagaccagaagatcggccagccttctccagactgctgcgtcaactggctgaaattgcagaatcaggactttagtagagactgagtaccaggccacgggctgcagatcctgaatggaggaaggatatgtcctcattccatagagcattagaagctgccaccagcccaggaccctccagaggcagcctggcctgtggcatcagtccctgagtcaccatggaagcagcatcctgaccacagctggcagtcaagccacagctggagggtcagccaccaagctgggagctgagccagaacaggagtgatgtctctgcccttcctctagcctcttgtcacatgtggtgcacaaacctcaacctgacagctttcagacagcattcttgcacttcttagcaacagagagagacatgagtaagacccagattgctatttttattgttatttttaacatgaatctaaagtttatggttccagggactttttatttgacccaacaacacagtatcccaggatatggaggcaaggggaacaaagagcatgagtctttttccaagaaaactggtgagttaagtaagattagagtgagtgtgctctgttgctgtgatgctgtcagccacagcttcctgccgtagagaatgatagagcagctgctcacacaggaggccggatattctgagaagcagctttatgaggttttacagagtatgctgctacctctctccttgaagggagcatggcgagacccattggatggattggggtgaacagttcaggtcccatgcttggagcattgggtatctgatgtctgcaccagaacaagagaacctctgacggtggagaaccatgtggtgcaagaagagatcttaggtctcttcttttataccaagctcatcttttataccaagctgtgcaggtgactatgcctcctcttctgcacagaatgcttccaccagcatcctgagaagaaatgattacttctgaaaaacatccttttttccagcctctgggaatcagccccccctctctgcactatccgatcctcatcaacagagggcagcattgtgttggtcaatgttcccttggcgagcaattgaaacttgtttaggccctagggttgagcaattttaaggttgagactccaagtctcctaaaattctaggagagaaataaagagtctgtttttgctcaaaccatcaggatggaaacagtcaggcactgactggggtgcttccaagaggcatgagagtgcctactctggcttgagcacttctatatgcaaggtgaatatgtactgagctaggagacttccctgcaaaatctctgttcaccctgggttcacatccccatgaggtaatattattattcccattttacaaataatgtaactgaggctttaaaaagccaagacatctgcccaaagtgatggaactagaaagtctagagctggtattctagcccaaatctgtctgaccgcaatacacagattctttattcctattcgacactggcttctactgaaaatgaaacggattgcagagggaataaatacaaagatggaaagccagtaaagaagtcagtatagaaccactagcgaatagtgttgctctggcacagaccactgtggttgatggcatggccctccaacttggaataggattttccttttcctattctgtatccttaccttggtcatgttaatgactttggagttattcagttaatgaccctttaattctcacaaccaaccagtcatgttgcttgaagccatttatagacgagcttcaaagcaactttaaaagattcttctgtagaagtatgagttcttcctttaattatcattccaactttcagctgtagtcttcttgaacacttcatgaggagggacattccctgatataagagaggatggtgttgcaattggctctttctaaatcatgtgacgttttgactggcttgagattcagatgcataatttttaattataattattgtgaagtggagagcctcaagataaaactctgtcattcagaagatgattttactcagcttatccaaaattatctctgtttactttttagaattttgtacattatcttttgggatccttaattagagatgatttctggaacattcagtctagaaagaaaacattggaattgactgatctctgtggtttggtttagaaaattcccctgtgcatggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaaaataaaaatgttacaaat

SEQ ID NO: 783 - DNA, 1704 bp, Homo sapiens
aaagtagtgatggctctcatcccagacttggccatggaaacccggcttctcctggctgtcagcctggtgctcctctatctatatggaactcattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctgtgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctctgtagagtgttatact

SEQ ID NO: 784 - DNA, 2011 bp, Homo sapiens
gcaagagcaaaagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaactagtgctagtgaaagaatgttattctgtcttcacaaaccgcgagccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaacgagagacaggcaagcctgtcaccttgaaagacgtctttggggcctacagcatggatgtgatcactagctcatcatttggagtgaacgtcgactctctcaacaatccacaggacccccttgtggaaaacaccaagaagcttttaagatttgattttttggatccattctttctctcaataacagtctttccattcctcatcccaattcttgaagtattaaatatctgtgtgtttccaagagaagttacaaattttttaagaaaagctgtaaaaaggatgaaagaaagtcgcctcgaagatacacaaaagcaccgagtggatttccttcagctgatgattgactctcataagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaagggtgggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaaggacttctgctttgctcttcagaaatctggtgcctgagaacaccagagacctcaaattactttgtgaatatgactctgaaatgagatggcttcatccaatgaactgcatagtatccggagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagta

SEQ ID NO: 785 - DNA, 2768 bp, Homo sapiens
cactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtc

SEQ ID NO: 786 - DNA, 1825 bp, Homo sapiens
gcaggctcagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggacgtgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcctagaccccagattcccgagcctcctggactgggtgcctgggccgcaccaacgcatcttccagaacttcaagtgcctgagagacctcatcgcccacagcgtccacgaccaccaggcctcgtctccccgggacttcatccagtgcttcctcaccaagatggcagaggagaaggaggacccactgagccacttccacatggataccctgctgatgaccacacataacctgctctttggcggcaccaagacggtgagcaccacgctgcaccacgccttcctggcactcatgaagtacccaaaagttcaagcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgggcgccgtctgtgcctgggagagctgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccacccatgtgggttgctacgtccccttcttggtccacagtctgccctcatccctctggcagtcacgctgtcttccctgcatgctgtgcctgccgcgtgcccttcccccatccctccaatctgtgccccgtctgcagggcagaggcagatgtggcatgtctttttgtacccacagagcttgttctatggcacgcccttttctaggctttttgtatcatttcttagtacattgtaatagattcaaaccagtcttgg

SEQ ID NO: 787 - DNA, 1826 bp, Homo sapiens
gcaggctctagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggagctgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcttcccgagcctcctggactgggtgcctgggccgcaccaacgcatcttccagaacttcaagtgcctgagagacctcatcgcccacagcgtccacgaccaccaggcctcgctagaccccagatctccccgggacttcatccagtgcttcctcaccaagatggcagaggagaaggaggacccactgagccacttccacatggataccctgctgatgaccacacataacctgctctttggcggcaccaagacggtgagcaccacgctgcaccacgccttcctggcactcatgaagtacccaaaagttcaagcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgggcgccgtctgtgcctgggagagtcgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccgcccatgcgggttgctacgtccccttcttggtccacagtctgccctcatccctctggcagtcacgctgtcttccctgcatgctgtgcctgccgcgtgcccttcccccatccctccaatctgtgccccgtctgcagggcagaggcagatgtggcatgtctttttgtacccacagagcttgttctatggcacgcccttttctaggctttttgtatcatttcttagtacattgtaatagattcaaaccagtcttgg

SEQ ID NO: 788 - DNA, 5680 bp, Homo sapiens
gggcgatgggttgatgggcgccgggggacgcaggatgcggggggcgcccgcgcgcctgctgctgccgctgctgccgtggctcctgctgctcctggcgcccgaggctcggggcgcgcccggctgcccgctatccatccgcagctgcaagtgctcgggggagcggcccaaggggctgagcggcggcgtccctggcccggctcggcggagggtggtgtgcagcggcggggacctcccggagcctcccgagcccggccttctgcctaacggcaccgttaccctgctcttgagcaataacaagatcacggggctccgcaatggctccttcctgggactgtcactgctggagaagctggacctgaggaacaacatcatcagcacagtgcagccgggcgccttcctgggcctgggggagctgaagcgtttagatctctccaacaaccggattggctgtctcacctccgagaccttccagggcctccccaggcttctccgactaaacatatctggaaacatcttctccagtctgcaacctggggtctttgatgagctgccagcccttaaggttgtggacttgggcaccgagttcctgacctgtgactgccacctgcgctggctgctgccctgggcccagaatcgctccctgcagctgtcggaacacacgctctgtgcttaccccagtgccctgcatgctcaggccctgggcagcctccaggaggcccagctctgctgcgagggggccctggagctgcacacacaccacctcatcccgtccctacgccaagtggtgttccagggggatcggctgcccttccagtgctctgccagctacctgggcaacgacacccgcatccgctggtaccacaaccgagcccctgtggagggtgatgagcaggcgggcatcctcctggccgagagcctcatccacgactgcaccttcatcaccagtgagctgacgctgtctcacatcggcgtgtgggcctcaggcgagtgggagtgcaccgtgtccatggcccaaggcaacgccagcaagaaggtggagatcgtggtgctggagacctctgcctcctactgccccgccgagcgtgttgccaacaaccgcggggacttcaggtggccccgaactctggctggcatcacagcctaccagtcctgcctgcagtatcccttcacctcagtgcccctgggcgggggtgccccgggcacccgagcctcccgccggtgtgaccgtgccggccgctgggagccaggggactactcccactgtctctacaccaacgacatcaccagggtgctgtacaccttcgtgctgatgcccatcaatgcctccaatgcgctgaccctggctcaccagctgcgcgtgtacacagccgaggccgctagcttttcagacatgatggatgtagtctatgtggctcagatgatccagaaatttttgggttatgtcgaccagatcaaagagctggtagaggtgatggtggacatggccagcaacctgatgctggtggacgagcacctgctgtggctggcccagcgcgaggacaaggcctgcagccgcatcgtgggtgccctggagcgcattgggggggccgccctcagcccccatgcccagcacatctcagtgaatgcgaggaacgtggcattggaggcctacctcatcaagccgcacagctacgtgggcctgacctgcacagccttccagaggagggagggaggggtgccgggcacacggccaggaagccctggccagaaccccccacctgagcccgagcccccagctgaccagcagctccgcttccgctgcaccaccgggaggcccaatgtttctctgtcgtccttccacatcaagaacagcgtggccctggcctccatccagctgcccccgagtctattctcatcccttccggctgccctggctcccccggtgcccccagactgcaccctgcaactgctcgtcttccgaaatggccgcctcttccacagccacagcaacacctcccgccctggagctgctgggcctggcaagaggcgtggcgtggccacccccgtcatcttcgcaggaaccagtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggagctgagcgcctttcccagggaggtggggggcgccggggcagggctgcaccccgtggtatacccctgcacggccttgctgctgctctgcctcttcgccaccatcatcacctacatcctcaaccacagctccatccgtgtgtcccggaaaggctggcacatgctgctgaacttgtgcttccacatagccatgacctctgctgtctttgcggggggcatcacactcaccaactaccagatggtctgccaggcggtgggcatcaccctgcactactcctccctatccacgctgctctggatgggcgtgaaggcgcgagtgctccataaggagctcacctggagggcaccccctccgcaagaaggggaccccgctctgcctactcccagtcctatgctccggttctatttgatcgctggagggattccactcattatctgtggcatcacagctgcagtcaacatccacaactaccgggaccacagcccctactgctggctggtgtggcgtccaagccttggcgccttctacatccctgtggctttgattctgctcatcacctggatctatttcctgtgcgccgggctacgcttacggggtcctctggcacagaaccccaaggcgggcaacagcagggcctccctggaggcaggggaggagctgaggggttccaccaggctcaggggcagcggccccctcctgagtgactcaggttcccttcttgctactgggagcgcgcgagtggggacgcccgggcccccggaggatggtgacagcctctattctccgggagtccagctaggggcgctggtgaccacgcacttcctgtacttggccatgtgggcctgcggggctctggcagtgtcccagcgctggctgccccgggtggtgtgcagctgcttgtacggggtggcagcctccgccctgggcctcttcgtcttcactcaccactgtgccaggcggagggacgtgagagcctcgtggcgcgcctgctgcccccctgcctctcccgcggccccccatgccccgccccgggccctgcccgccgccgcagaggacggttccccggtgttcggggaggggcccccctccctcaagtcctccccaagcggcagcagcggccatccgctggctctgggcccctgcaagctcaccaacctgcagctggcccagagtcaggtgtgcgaggcgggggcggcggccggcggggaaggagagccggagccggcgggcacccggggaaacctcgcccaccgccaccccaacaacgtgcaccacgggcgtcgggcgcacaagagccgggccaagggacaccgcgcgggggaggcctgcggcaagaaccggctcaaggccctgcgcgggggcgcggcgggggcgctggagctgctgtccagcgagagcggtagtctgcacaacagccccaccgacagctacctgggcagcagccgcaacagcccgggcgccggcctgcagctggaaggcgagcccatgctcacgccgtccgagggcagcgacaccagcgccgcgccgctttctgaggcgggccgggcaggccagcgccgcagcgccagccgcgacagtctcaagggcggcggcgcgctggagaaggagagccatcgccgctcgtacccgctcaacgccgccagcctaaacggcgcccccaaggggggcaagtacgacgacgtcaccctgatgggcgcggaggtagccagcggcggctgcatgaagaccggactctggaagagcgaaactaccgtctaaggtggggcgggcgacgcggtagacgggctggccacgcggctcgttcccccgctcctcggggccctccaaggtgtctccgtagtcagcaggttggaggcagaggagccgatggctggaggaagcccacaggcggatgttccccacttgcctagagggcatccctctggggtagcgacagacaatcccagaaacacgcataatacatttccgtccagcccggggcagtctgactgtcggtgccctcccaggaacggggaaggcctccgtctgtgtgaaagggcacagcacatcccaggtgcaccctccccaagtactcccaccccgcctactgtccatgcggcctcactgggggccatcagcctcaccagcaaagcagagatgagagcgtgggaactgtgttctttcctccctgccctctactgatttcagcccagcccctgcctagatcctaggtcccttttcctcccgagtttggctggcacgagagctagcccagcacatgaagcaggtgatgttaagtcacaaggtgctgcttttcagatccactatgcaagaggggagggtggggccacgtgaaaggcagctctagacatcaaccagtcctgggggaggggagtgggaaccgggcacaactaggaacaatgccaccattcccacaggagtggtacttaaaccagacagcagggttcagaggtggcacaccgggacaaagctgaggccctgcacctcaacagctgactgccaggtgcctgtgggtgaactgaggggagtagagggagagggcaggtggaactggggcagaatctagtcatgccctaaagctagtcctgtaaacaatggtgccccagaaagctgcaggtggtgtttggagaagcagttacttttcagttacaagacccatctccctagtctcagccttacaacaccacgggactaaggaagagcacttccttgcctccgtaaggccagaggaagaaccatcccaatcatttgatctccagctccacagtagagagaaacctacaaaatgtcaaaccagcttcccgactcccaggagctcaagccaagcccagaggcagtggctggggtccctgcaggtcatgaggggcctatgcctttactccttttaaacaccagcacccgtcttttccccaacctaaaaccaaccaccagcatttcactacaggaccaaatggaaaccgagggaaccctgggtcttgggaagaacaacaggaaaccaaggtctgacctagggttccctcccagtcttcacatcactctggcctcatcaccaaggtgacagaggacacaggggagggggaaaacccacacacactccttggaatgggtcctgttatttatgcttgctgcacagacatattagaagaaaaaaaaaagctttgtattattcttccacatatgctggctgctgtttacacaccctgccaatgccttagcactggagagctttttgcaatatgctggggaaaggggagggagggaatgaaagtgccaaagaaaacatgtttttaagaactcgggttttatacaatagaatgttttctagcagatgcctcttgttttaatatattaaaattttgcaaagccctttgagctacaaaaaaaaaaaaaaaaaaaaaaaaaaaaaaa

SEQ ID NO: 789 - DNA, 1131 bp, Homo sapiens
atgaaggagggcatgagagttctgactcagctggtggccacttacccccagggctttaagatctggatgaaccccattactcccatcatcaggttgtgccaccccaacatcatctggtctgtcatcaatgcctcagccaccattgcaccaaaagacgaggccttctacaagttcctgaagccctggctgggggatgggctcctggtaaatgccagtgacaagtggagctgccaccgtcagatgctgatgcccgccttccatttcaacatgctgaagccctatatgaagtttttcactgacagtgtgaatatcatgcacgccaagtggcagctcctggcctcagggggcagtgcccatctggacatgtttgagcacaccagcctcatgaccttggacagtgtgcagaaatgtgtcttcagctttgacagccattgtcaggacggatggcgcttccgcagggcctgctgcctggttcatgacttcacagaagctatcatccaggagcagcgccacacccttactagccagggtgttgattatttccacgaagtaaaggccaagtccaagactttggacttcactgatgtactcctgctgagcaaggatgaagattggaaggagttgtctgatgaggaaataagagcagaagctgacaccttcatgtttgaggatgagtgtcccagtcataacaccacggccagtggcctctcctgggtcctatactaccttgcaaggcacccagaataccaggagcactgctgggatgacctggcccagctgcccttcctgaccatgtacattaaggacagcctgtggctgcatcccccagtccctgtcatctcccgatgctgcacccaggacattgtctatgaccccttccgctttgacccagagaatagcaaagagagatcacctctggcttttattcccttctcagcagggtccagacaagggaactgcattgggcaggcgtttgcaatggctgagatgaaggtggtcctggcgctcacgctgctgtgcttccgtgtctgtccagaccacatggagccccgcaggaagccggaggtcataatgtatgcagagggcggactttggctgtgggtgaagcccctgagcgcagacccacagtga

SEQ ID NO: 790 - DNA, 2684 bp, Homo sapiens
ccgccgccagcatgccccggcccgcgggccgctccgccgccagccacccccgcggccctcggcggcctgcgctcggcccgggggcgcgggaaccgcagccggagccggaggcgggagcagcgagccggagccccgggcgctcgaatgcaggatgctcgtggtccccagcatccttgagccaccaggagtgagggctgctgctccctgagacctggctccaaggaggatgccacagccgcctgccagctccggtctgcaccatgagtgatgagcggcggctgcctggcagtgcagtgggctggctggtatgtgggggcctctccctgctggccaatgcctggggcatcctcagcgttggcgccaagcagaagaagtggaagcccttggagttcctgctgtgtacgctcgcggccacccacatgctaaatgtggccgtgcccatcgccacctactccgtggtgcagctgcggcggcagcgccccgacttcgagtggaatgagggtctctgcaaggtcttcgtgtccaccttctacaccctcaccctggccacctgtttctctgtcacctccctctcctaccaccgcatgtggatggtctgctggcctgtcaactaccggctgagcaatgccaagaagcaggcggtgcacacagtcatgggtatctggatggtgtccttcatcctgtcggccctgcctgccgttggctggcacgacaccagcgagcgcttctacacccatggctgccgcttcatcgtggctgagatcggcctgggctttggcgtctgcttcctgctgctggtgggcggcagcgtggccatgggcgtgatctgcacagccatcgccctcttccagacgctggccgtgcaggtggggcgccaggccgaccaccgcgccttcaccgtgcccaccatcgtggtggaggacgcgcagggcaagcggcgctcctccatcgatggctcggagcccgccaaaacctctctgcagaccacgggcctcgtgaccaccatagtcttcatctacgactgcctcatgggcttccctgtgctggtggtgagcttcagcagcctgcgggccgacgcctcagcgccctggatggcactctgcgtgctgtggtgctccgtggcccaggccctgctgctgcctgtgttcctctgggcctgcgaccgctaccgggctgacctcaaagctgtccgggagaagtgcatggccctcatggccaacgacgaggagtcagacgatgagaccagcctggaaggtggcatctccccggacctggtgttggagcgctccctggactatggctatggaggtgattttgtggccctagataggatggccaagtatgagatctccgccctggaggggggcctgccccagctctacccactgcggcccttgcaggaggacaagatgcaatacctgcaggtcccgcccacgcggcgcttctcccacgacgatgcggacgtgtgggccgccgtcccgctgcccgccttcctgccgcgctggggctccggcgaggacctggccgccctggcgcacctggtgctgcctgccgggcccgagcggcgccgcgccagcctcctggccttcgcggaggacgcaccaccgtcccgcgcgcgccgccgctcggccgagagcctgctgtcgctgcggccctcggccctggatagcggcccgcggggagcccgcgactcgccccccggcagcccgcgccgccgccccgggcccggcccccgctccgcctcggcctcgctgctgcccgacgccttcgccctgaccgccttcgagtgcgagccacaggccctgcgccgcccgcccgggcccttccccgctgcgcccgccgcccccgacggcgcagatcccggagaggccccgacgcccccaagcagcgcccagcggagcccagggccacgcccctctgcgcactcgcacgccggctctctgcgccccggcctgagcgcgtcgtggggcgagcccggggggctgcgcgcggcgggcggcggcggcagcaccagcagcttcctgagttccccctccgagtcctcgggctacgccacgctgcactcggactcgctgggctccgcgtcctaggaccgccggcgcctccccacggacgccaggcaggccaggccgctctccggggccgcagcaccaaagacgcccgcctcccccccgcgcgcagacatgcgccacccctcccaggggtgagggggcgttggcctcagcgtttgtcttccggctcctcccagctggccttgtcccaggggcgacggctgccccggacgactgcgctgggcaccgcatgtcccgggccgagtgaggtcgggcctggggagctgagtgacatcccaagcttgggcttgggtagtgagtgacatgtgcacacgtccagctgcgccatcaccagccctgcgcaacaggacgtcgggagcagggaacctgagacagggccactgcgggatcggacaaagccccgctttggagaggctgagctggagccattggcctccccaggggctttccacccacactgcaccataaccgccacacccttcggggggggggagggtacagagggtctctaagcacaggggtgttcagagcccgaacaagctttgatcaggtttccctgcaaaaaaaaaaaaaaaaaaaaaaaaaaaaaaaaaaaaaaaaaaaaaaaaaaaa

SEQ ID NO: 791 - DNA, 4725 bp, Homo sapiens
agtctccttgtgcgatctcccagacatgagagccctgctgggctttctggctcctcctccgtgcagagttgtcccgtcaggagccaggaggggcgacgctggctccgtgggagggtgaacagtggctcaagatgagaagcgtattgagacaaagaattctgaaaccgaaagatgtggccatttattctggagaagtcaaccaagttattgctgacttaattaaaagaatctacctcctcaggagccaggcagaagatggagaaaccgtgaccaatgtcaatgatcttttcttcaaatattcaatggaaggagtggccaccatcctttatgagagtcgtttgggctgcctggaaaacagcatcccacagctgactgtggaatacatcgaggccctggagctcatgtttagcatgttcaagacctccatgtatgcaggcgccatccccagatggcttcgccccttcatcccaaagccctggcgggaattctgcaggtcctgggatggactcttcaaattcagccaaattcatgttgacaacaagttgagggacatacagtaccaaatggaccgaggccggagggtgagcgggggacttctcacatacctcttccttagccaggctctgacgctgcaggagatctacgccaacgtgactgagatgctgctggccggcgtcgacacgacgtccttcaccttgtcttggactgtgtacatcctggcaaggcacccagaagtgcagcagacggtgtaccgggagattgtgaagaatttaggggaaaggcatgttccaactgcagctgatgtccccaaggtcccgctggtcagagctctccttaaggaaaccctgaggctgtttccagtgctgccagggaacggccgggtcacccaggaagacctggttattggcgggtatctgattccgaaaggcacccagctggccctttgccactatgccacatcgtaccaggatgagaacttccctcgggccaaggagttccggcctgagcgctggctgcggaaaggagacttagatagagttgacaattttggatccatcccctttggtcatggggttcgcagctgcatagggcggagaattgcagaactggagattcacctcgtcgtgatccagttgcttcaacattttgagatcaaaacatcttctcagaccaatgctgttcatgcaaaaacccacgggctcctgacgccaggggggcccatccacgtgcgatttgttaacagaaagtaagcctagattttaaacctgggctgatgtagcagaccagctcgccgacacacagtgggtatttgtgttcgctgatcaccgtggagaaggaaagcgatgtcgctaaaggctgtcttgttatagactggcctcccaggtcctgggacacttgtaaatctttatgcaaagtaatgtaaaaaggttgctattttactggtgcataccagaagttgccctttctttgggggaaacagctgtttaaaaaccagtggcagtgaatttttatgcttcatacattgtgctagactcaatatttaatgactggcagtatcctgtgcatttacttgtacagggaaatggtggtttacttacaaattcagttcttcaatatatgttctctaatactggcatctgggctcaaattgccatcaacagtaagttgaaggcaatttcaacttactgtttctaatttgaagagggaacattaagaatgcctctgtaatactgtaattatgggaagaaagcaccagaggcaacattttatcctgagcaccagatttagatcctgttaaagggctcaaacttaaaagggctggccgggtgcggtggctcacgcctgtaatcccagcactttgggaggtcaaggtgggaggattgcttgagccagaagttcgagaccagcctgagcaacatggtgaaaccctgtctctaccaaaaatacaaaaattagccgggcgtggtggtgtacacctatggtcctagttactcggaagactgaggcaggaggatcgtttgagctcaggaggttgggtctgcagtgagctatctatgatggcaccactgcacttcagcctgggtgacagagtgagaccctttctcaaaaataaaataaaataaaataaaataaaataaaataaaataaaataaaatggctgtataagaatacttttctctccacaacgagtgcttaattttctagtcataatgcctaatgaagttgactattagtttttatttggaagaaataaataataaataaataataaataaataaaaaagaaagctcctggtgaaatcaagaataatcagattttctaaccaaatctaaatacagagtagagcagacgtataagaactggaaatatgatgacgtaaaattttgttgcctaagttgtgagaagtaataaaacaggcagcatggaaaacaatgtaactttagaacatttttatttcaagggaaaataaatacataaatagagatgctatagatacaacaatatttttatcttgatggtgttgttttaaatatccacacaagaaccctcacccagttgtgtgcctgtgccaggctctctgggaagccgtggctccgggagtgctgggtcctgaggagttctgttgcctttcctgctgctcaccggttgctaagaggaaacaccgtgatttcctgatgctcttgccttgtcatcatgcctgaaacagcttattcccaattctgtaattccttttacataatccttctccaaaaattactttcttactaatatagaccatacagttttttttccatttagtaagtcactctgcaaaataacccttaagtaaatagacataatatccatttcacataccatttttgttaaagtatataataaagttgaaatctctgtgtggtagcagaataactctagtatgaatgctgtaaatgtacaggtaaatgtgaaattaggtcatattaactggccaagtgttggattgattactttgaggtagcagtatacgtatattaagttttataaactagatgaaattgcattctgtttgagactgaaatttaaaaatattgagaataactaagcgacttgaagtgacctcttattccctgggtatacatacagtgtgaccctctcgtgaagtgtggctctgcctggggatcagcacagggtgaatagcaaagtgcgggctgggggtagcacctgtgcccgctgctgagtctcactgaacaggaagggaagcagccagacacgggggcctcctggtgtgatgtagcaggaagtgcagggcgccacccaggaagcatccacgccaaagaaatggagattcagctggacaagtttctaggttcgctactggtttataggaaatatgtggtatacagggagatgtcaaaactccatgggggctgggcgtggtggctcacacctgtaatttcagcactctggggaggttgaggcaggaggattgcttgaggccaggagtttgagacaagcttgggcaacacagtgagatcctgtctactaaaaatcaaaaaacttagctgagtgtggtggtgcatgcctgtagtcctagctatttgggaggctgaggctggaggattgcttaagtctgggaggttgaggctgcagtgagctgtgatccgccattacactccagcctgggtgacagagcaagacttcataacaaacaaacacacaaacaaactccatggggatgcagtcagcaaaatccagaatagagtgaggtctataggaccaatgtctcgggtttccaacaaaacaaatacgtgacaggcaaaaaacaagaggaggggccaggcgaggtggctcatgcctgtaatcccagcactttgggaggccaaggcgggcggataacctgaggtcaggggttccagaccagcctggccaacatggtgaaaccccatctctactaaaaatacagaaattatccaggcatggtggcgggcttctgtaattccagctacttgggaggctgaggcaggagaattgcttgaacctgggaggcagtttgcagtgagctgagatcacgccactgcactccacctgggcaacaagaacgaaactccgtatctaaaaaaaacaaaaaccaaaaagcaaaaaaaaaaccaaggggagaggagaactgttacagatgaagcaatataggagacatattaaccaagtacaatgctggacttcgtttgaatcagattcaaataaaccacttgtaaaaagacatttaagagataatttttaaaaataaaataaaagccaaaaatattaattcttccaatgcatgaaaaaaagagagcaactcggggaaatttgaatgctgactgtgtgtatttgatgatatttgggaattactgttaatttttttgttgtgataatggtagttatgttttaaaaaaagagactttatctcttggagatagctcttaaagatataaatgtttatggctgaaatgttatggcatcttggatttgctttaaaataacccagcttgctgcaggaggtgggtattgtgtgtgtgggaaggtggggaggctgcgggaggaagagatgacccaagattaggcagatgttgttaactgtggaagcagggtggtgagtgggggctcatgacattatgctctctactttgtgtacgtgtgaacatttccgtaataaaagatgccttcagaaacaaaaaaaaaaaaaaaaaagaaaaaaaaaaaaaaaa

SEQ ID NO: 792 - DNA, 2681 bp, Homo sapiens
gcagggtgggggcaggccagctcagcagagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcctgaaggctttggtccagaacctcagcaccaacactgcagaagacttctatttctctctggagccctctcaggttccgaggcaggtgatgaaggacgaggacaagccccctgacagagtgcgacttcccaagagcctttttcgatccctgccaggcaacaggtctgtggtccgcttggccgtcaccattctggacattggtccagggactctcttcaagggcccccggctcggcctgggagatggcagcggcgtgttgaacaatcgcctggtgggtttgagtgtgggacaaatgcatgtcaccaagctggctgagcctctggagatcgtcttctctcaccagcgaccgccccctaacatgaccctcacctgtgtattctgggatgtgactaaagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagtggtcaaggagcgggggaagaaccggaagaaggtgctcaccctgctgggcctctcgagcctggtgggtgtgacatgggggttggccatcttcaccccgttgggcctctccaccgtctacatctttgcacttttcaactccttgcaaggtgtcttcatctgctgctggttcaccatcctttacctcccaagtcagagcaccacagtctcctcctctactgcaagattggaccaggcccactccgcatctcaagaataggaaggcacggccctgcaatatggactcagctctggctctctgtgtgaccttgggcagctccgtgcctctctctgtactccctcagtttccttctctgtacaatgtggctggggagggagaggatgggaccaggttggaccacgtggcatcagaggtcccatccagatccaactataggtccaagagtccacgtaagcaggtttgcaaggctctaaagttcctatagtcctgagaccccctgccagcaaagagtgacagtcacctccatgccctgccctcattgcaaagccctcactcaccttctggtctcagcaagggaggagagtctgttgctggcatagccctggaaggagcccccagcctctcccctcctcctccttgtcactggcctcccacaactccccttctggctgcctgtaaccttgaggggcattcaggaggccagcgttccctcaggcactgggggtttgttttggggggtgggagttgatcctcccacccagtctgcccctggtctctgcccatccaatcagagcccaccctcctggaagagacccccgtgttcagagtgctggcagccctgcacgtgtccagggacactgcatttcaaagaaccactgagtgggtgagctaccttgggcaaaccccccactcctgactctgactgccacgtgggtggcccgacctctgacctgctgtcatcatagaggtagaaagcaaacaatctggggctcagcacacctgggggtgctcccactcattcagtgtgtggggcccctgagcagaggctgggcattgccactagaacctgagctcctagagagcaaggacctgggtggcctcgcttactgttccagcccaggccaagcacagggcctggctcgtggcaaaccttgaataaatatttgttggctgaaaaaaaaaaaaaaaaaaaaaaaaaaa

SEQ ID NO: 793 - DNA, 560 bp, Homo sapiens
tactgcttccatttctcccacatattcccactgatgccagtgatattaatataccaagcccctcaaagagccaaggtagcatggagaatgtgtctgcattgtcactgttgactgtggagagtcccacgtccatgtttgactattgtgatgactctttggagagggtcaagtctgctcttgacatcttttccatgatcatctacacagtgactttcttcctaggcttggctggcaatggccttgtcatttgggtagttggattccacatgtcctgcacagtcaacacggtccttgcgactgtggtaaccaccttcttcctctgctggttgcccttgcaagtgtccctgtggctggacttcacatcatttcgggaagacagagagggcctgaaccaggtggccttactcctaagacccctggccttgtctatggcctttatcaacagctgtctcaatccagttctctatgtcttcattgggcatgatttctgggagcacttgctccactccctgctagctgccttagaacgggcacttagtgaggagccagatagtgcctga

SEQ ID NO: 794 - DNA, 336 bp, Homo sapiens
atgttcagccctctcagcaaccgagggggcagctctttaatttctgatctcagaagaaccgactgccgagaaattcaaaacacatccgtgaaagcagaaaattataatgtgacaagtgaagaattgaaatggattcaccctaaaagcagagccaaatatcagccattgtcatgggcccctaggaggactgagtctggtgatgcacgaataccagaatgcaagtgtggtgcaatgacagcaataacacatgtgtgcaccttgaagccagagggatggaaaccccagccaatgtctctttctcttttcagccatgtaaattccaatcttgatcaataa

SEQ ID NO: 795 - DNA, 1095 bp, Homo sapiens
atggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcattgcatccgttttcacaaatgggcttgtgctggcggccaccatgaagttcaagaagctgcgccacccgctgaactggatcctggtgaacctggcggtcgctgacctggcagagaccgtcatcgccagcactatcagcgttgtgaaccaggtctatggctacttcgtgctgggccaccctatgtgtgtcctggagggctacaccgtctccctgtgtgggatcacaggtctctggtctctggccatcatttcctgggagagatggatggtggtctgcaagccctttggcaatgtgagatttgatgccaagctggccatcgtgggcattgccttctcctggatctgggctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcaccccactcagcatcatcgtgctctgctacctccaagtgtggctggccatccgagcggtggcaaagcagcagaaagagtctgaatccacccagaaggcagagaaggaagtgacgcgcatggtggtggtgatggtcctggcattctgcttctgctggggaccatacgccttcttcgcatgctttgctgctgccaaccctggctaccccttccaccctttgatggctgccctgccggccttctttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatga

SEQ ID NO: 796 - DNA, 1356 bp, Homo sapiens
acagggctttccatagccatggcccagcagtggagcctccaaaggctcgcaggccgccatccgcaggacagctatgaggacagcacccagtccagcatcttcacctacaccaacagcaactccaccagaggccccttcgaaggcccgaattaccacatcgctcccagatgggtgtaccacctcaccagtgtctggatgatctttgtggtcactgcatccgtcttcacaaatgggcttgtgctggcggccaccatgaagttcaagaagctgcgccacccgctgaactggatcctggtgaacctggcggtcgctgacctagcagagaccgtcatcgccagcactatcagcattgtgaaccaggtctctggctacttcgtgctgggccaccctatgtgtgtcctggagggctacaccgtctccctgtgtgggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtactggccccacggcctgaagacttcatgcggcccagacgtgttcagcggcagctcgtaccccggggtgcagtcttacatgattgtcctcatggtcacctgctgcatcatcccactcgctatcatcatgctctgctacctccaagtgtggctggccatccgagcggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcagtttcgaaactgcatcttgcagcttttcgggaagaaggttgacgatggctctgaactctccagcgcctccaaaacggaggtctcatctgtgtcctcggtatcgcctgcatgaggtctgcctcctacccatcccgcccaccggggctttggccacctctcctttccccctccttctccatccctgtaaaataaatgtaatttatctttgccaaaaccaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaa

SEQ ID NO: 797 - DNA, 2776 bp, Homo sapiens
ggaaaacgacacctagaagtaggagtgagattcgctgaagttcccttctgaggaagacccacccctccgcctggagagccggggctggcggtgcctgaggaccccttcggcctggacagcccacgcgggcttggggggcctcgctctgccctcatggggcggccatcggttcccgaagcggcgagtgaaaattcaaatggccagtagggggcgcactcggaagtggccgccccgcatgaggcagttcagcggccccgagagtccggggagggaggtttattctccgcctgcacgagactgtgaaatccgcaaccatgagcaggagaggcggccctggtggggaagaggccaccaacatctggacggcaggtacccagagagtgagcagctccacgcgggactgtgcacggtggccgacacccgcagggacgcccgccggacgagcacgcggagggccctcgcctccacggatgcaccatgccggtgtgaggagcatctgttcttcccactctctgcagttaacaaacccaacccaaaccaccacaggtgctcctcctggggagtttcctgtctgacaaatgccaggctcacttcaaggagaatcacgcttctttctaaagatggattcaccatttaaaacagagctctgggagcctttcggcaaatcttgaaagctgcacggcgcagagacatggatgtgacttcccaagcccggggcgtgggcctggagatgtacccaggcaccgcgcagcctgcggcccccaacaccacctcccccgagctcaacctgtcccacccgctcctgggcaccgccctggccaatgggacaggtgagctctcggagcaccagcagtacgtgatcggcctgttcctctcgtgcctctacaccatcttcctcttccccatcggctttgtgggcaacatcctgatcctggtggtgaacatcagcttccgcgagaagatgaccatccccgacctgtacttcatcaacctggcggtggcggacctcatcctggtggccgactccctcattgaggtgttcaacctgcacgagcggtactacgacatcgccgtcctgtgcaccttcatgtcgctcttcctgcaggtcaacatgtacagcagcgtcttcttcctcacctggatgagcttcgaccgctacatcgccctggccagggccatgcgctgcagcctgttccgcaccaagcaccacgcccggctgagctgtggcctcatctggatggcatccgtgtcagccacgctggtgcccttcaccgccgtgcacctgcagcacaccgacgaggcctgcttctgtttcgcggatgtccgggaggtgcagtggctcgaggtcacgctgggcttcatcgtgcccttcgccatcatcggcctgtgctactccctcattgtccgggtgctggtcagggcgcaccggcaccgtgggctgcggccccggcggcagaaggcgctccgcatgatcctcgcggtggtgctggtcttcttcgtctgctggctgccggagaacgtcttcatcagcgtgcacctcctgcagcggacgcagcctggggccgctccctgcaagcagtctttccgccatgcccaccccctcacgggccacattgtcaacctcgccgccttctccaacagctgcctaaaccccctcatctacagctttctcggggagaccttcagggacaagctgaggctgtacattgagcagaaaacaaatttgccggccctgaaccgcttctgtcacgctgccctgaaggccgtcattccagacagcaccgagcagtcggatgtgaggttcagcagtgccgtgtagacagccttggccgcataggcccagccagggtgtgactcgggagctgcacacacctgggtggacacaaggcacggccacgtcatgtctctaaactgcggtcagatgtggcttctggctcctcggggcctcgcgagggtcacgcttgcctggtcaccctggggctgcttaggaaacctcacgactggtcaccttgcactcttcacacagaattgctacaatcccaaagcgctcgccccgcagggtccaaaggccagcggtgaccagcctgtcacccagctcctccccgccaaccctgcctgccgctgcacctgcctgccgctgcaggaaacatttgacaccgtcgaccaggaaagccacacggagaggccactgtgggtgaagcgcctcagttacacaggaaccctaaagcaaatctgccaccgtgggggaactgacgctggagatgcaaggtgctggtgggtctgagctggacgtcgcggtgtgtcctctgtgcccacggtctgagctagctagcgcaccgccgagttaaagaggagaaggaaaacatgctgctctggtgcacgcctgagcgtcctccatcttccaggatggcagcaatggcgctgtgcggcctcaccaggcccacgaggagcagcagcgctcggcccggagcagcaggaaggcccctctgtggagcgcccgccgtctgctccggggtggttcagtcactgcttgttgacatcaacatggcaattgcactcatgtggactgggaccgtgcgagctgccgtgtgggttagtcgggtgccaggacaatgaaatactccagcacgtgtggctgacgaatttgtttctacagaaataacagctggggacaactgcggtgatgatgtaaaaaccttcccataaaatgtaagaaaagctgatgaggctggtgacgttcagcctttgtcaataaacctgtcatgtgcggatcctt

SEQ ID NO: 798 - DNA, 1101 bp, Homo sapiens
ggcatccatgagaaaaatgtcggaggaagagttttatctgttcaaaaatatctcttcagtggggccgtgggatgggcctcagtaccacattgcccctgtctgggccttctacctccaggcagctttcatgggcactgtcttccttatagggttcccactcaatgccatggtgctggtggccacactgcgctacaaaaagttgcggcagcccctcaactacattctggtcaacgtgtccttcggaggcttcctcctctgcatcttctctgtcttccctgtcttcgtcgccagctgtaacggatacttcgtcttcggtcgccatgtttgtgctttggagggcttcctgggcactgtagcaggtctggttacaggatggtcactggccttcctggcctttgagcgctacattgtcatctgtaagcccttcggcaacttccgcttcagctccaagcatgcactgacggtggtcctggctacctggaccattggtattggcgtctccatcccacccttctttggctggagccggttcatccctgagggcctgcagtgttcctgtggccctgactggtacaccgtgggcaccaaataccgcagcgagtcctatacgtggttcctcttcatcttctgcttcattgtgcctctctccctcatctgcttctcctacactcagctgctgagggccctgaaagctgttgcagctcagcagcaggagtcagctacgacccagaaggctgaacgggaggtgagccgcatggtggttgtgatggtaggatccttctgtgtctgctacgtgccctacgcggccttcgccatgtacatggtcaacaaccgtaaccatgggctggacttacggcttgtcaccattccttcattcttctccaagagtgcttgcatctacaatcccatcatctactgcttcatgaataagcagttccaagcttgcatcatgaagatggtgtgtgggaaggccatgacagatgaatccgacacatgcagctcccagaaaacagaagtttctactgtctcgtctacccaagttggccccaactgaggacccaatattggcctgtttgcaacagctagaattaaattttactt

SEQ ID NO: 799 - DNA, 3851 bp, Homo sapiens
ctctcccaaccgcctcgtcgcactcctcaggctgagagcaccgctgcactcgcggccggcgatgcgggaccccggcgcggccgctccgctttcgtccctgggcctctgtgccctggtgctggcgctgctgggcgcactgtccgcgggcgccggggcgcagccgtaccacggagagaagggcatctccgtgccggaccacggcttctgccagcccatctccatcccgctgtgcacggacatcgcctacaaccagaccatcctgcccaacctgctgggccacacgaaccaagaggacgcgggcctcgaggtgcaccagttctacccgctggtgaaggtgcagtgttctcccgaactccgctttttcttatgctccatgtatgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaaccgggccgtgccaacggcctgatgtactttaaggaggaggagaggcgcttcgcccgcctctgggtgggcgtgtggtccgtgctgtgctgcgcctcgacgctctttaccgttctcacctacctggtggacatgcggcgcttcagctacccagagcggcccatcatcttcctgtcgggctgctacttcatggtggccgtggcgcacgtggccggcttccttctagaggaccgcgccgtgtgcgtggagcgcttctcggacgatggctaccgcacggtggcgcagggcaccaagaaggagggctgcaccatcctcttcatggtgctctacttcttcggcatggccagctccatctggtgggtcattctgtctctcacttggttcctggcggccggcatgaagtggggccacgaggccatcgaggccaactcgcagtacttccacctggccgcgtgggccgtgcccgccgtcaagaccatcactatcctggccatgggccaggtagacggggacctgctgagcggggtgtgctacgttggcctctccagtgtggacgcgctgcggggcttcgtgctggcgcctctgttcgtctacctcttcataggcacgtccttcttgctggccggcttcgtgtccctcttccgtatccgcaccatcatgaaacacgacggcaccaagaccgagaagctggagaagctcatggtgcgcatcggcgtcttcagcgtgctctacacagtgcccgccaccatcgtcctggcctgctacttctacgagcaggccttccgcgagcactgggagcgcacctggctcctgcagacgtgcaagagctatgccgtgccctgcccgcccggccacttcccgcccatgagccccgacttcaccgtcttcatgatcaagtacctgatgaccatgatcgtcggcatcaccactggcttctggatctggtcgggcaagaccctgcagtcgtggcgccgcttctaccacagacttagccacagcagcaagggggagactgcggtatgagccccggcccctccccacctttcccaccccagccctcttgcaagaggagaggcacggtagggaaaagaactgctgggtgggggcctgtttctgtaactttctccccctctactgagaagtgacctggaagtgagaagttctttgcagatttggggcgaggggtgatttggaaaagaagacctgggtggaaagcggtttggatgaaaagatttcaggcaaagacttgcaggaagatgatgataacggcgatgtgaatcgtcaaaggtacgggccagcttgtgcctaatagaaggttgagaccagcagagactgctgtgagtttctcccggctccgaggctgaacggggactgtgagcgatccccctgctgcagggcgagtggcctgtccagacccctgtgaggccccgggaaaggtacagccctgtctgcggtggctgctttgttggaaagagggagggcctcctgcggtgtgcttgtcaagcagtggtcaaaccataatctcttttcactggggccaaactggagcccagatgggttaatttccagggtcagacattacggtctctcctcccctgccccctcccgcctgtttttcctcccgtactgctttcaggtcttgtaaaataagcatttggaagtcttgggaggcctgcctgctagaatcctaatgtgaggatgcaaaagaaatgatgataacattttgagataaggccaaggagacgtggagtaggtatttttgctactttttcattttctggggaaggcaggaggcagaaagacgggtgttttatttggtctaataccctgaaaagaagtgatgacttgttgcttttcaaaacaggaatgcatttttccccttgtctttgttgtaagagacaaaagaggaaacaaaagtgtctccctgtggaaaggcataactgtgacgaaagcaacttttataggcaaagcagcgcaaatctgaggtttcccgttggttgttaatttggttgagataaacattcctttttaaggaaaagtgaagagcagtgtgctgtcacacaccgttaagccagaggttctgacttcgctaaaggaaatgtaagaggttttgttgtctgttttaaataaatttaattcggaacacatgatccaacagactatgttaaaatattcagggaaatctctcccttcatttactttttcttgctataagcctatatttaggtttcttttctatttttttctcccatttggatcctttgaggtaaaaaaacataatgtcttcagcctcataataaaggaaagttaattaaaaaaaaaaagcaaagagccattttgtcctgttttcttggttccatcaatctgtttattaaacatcatccatatgctgaccctgtctctgtgtggttgggttgggaggcgatcagcagataccatagtgaacgaagaggaaggtttgaaccatgggccccatctttaaagaaagtcattaaaagaaggtaaacttcaaagtgattctggagttctttgaaatgtgctggaagacttaaatttattaatcttaaatcatgtactttttttctgtaatagaactcggattcttttgcatgatggggtaaagcttagcagagaatcatgggagctaacctttatcccacctttgacactaccctccaatcttgcaacactatcctgtttctcagaacagtttttaaatgccaatcatagagggtactgtaaagtgtacaagttactttatatatgtaatgttcacttgagtggaactgctttttacattaaagttaaaatcgatcttgtgtttcttcaaccttcaaaactatctcatctgtcagatttttaaaactccaacacaggttttggcatcttttgtgctgtatcttttaagtgcatgtgaaatttgtaaaatagagataagtacagtatgtatattttgtaaatctcccatttttgtaagaaaatatatattgtatttatacatttttactttggatttttgttttgttggctttaaaggtctaccccactttatcacatgtacagatcacaaataaatttttttaaatac

SEQ ID NO: 800 - DNA, 2462 bp, Homo sapiens
gcccctcatcccaggcagagagcaacccagctctttccccagacactgagagctggtggtgcctgctgtcccagggagagttgcatcgccctccacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacat

SEQ ID NO: 801 - DNA, 2544 bp, Homo sapiens
gggtagctgcctgctcagaacccacaaagcctgcccctcatcccaggcagagagcaacccagctctttccccagacactgagagctggtggtgcctgctgtcccagggagagttgcatcgccctccacagagcaggcttgcatctgactgacccaccatgacacccacagacttcacaagccctattcctaacatggctgatgactatggctctgaatccacatcttccatggaagactacgttaacttcaacttcactgacttctactgtgagaaaaacaatgtcaggcagtttgcgagccatttcctcccacccttgtactggctcgtgttcatcgtgggtgccttgggcaacagtcttgttatccttgtctactggtactgcacaagagtgaagaccatgaccgacatgttccttttgaatttggcaattgctgacctcctctttcttgtcactcttcccttctgggccattgctgctgctgaccagtggaagttccagaccttcatgtgcaaggtggtcaacagcatgtacaagatgaacttctacagctgtgtgttgctgatcatgtgcatcagcgtggacaggtacattgccattgcccaggccatgagagcacatacttggagggagaaaaggcttttgtacagcaaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcaggagcactctccctctgaggggtcttctctgaggtgcatggttcttttggaagaaatgagaaatacagaaacagtttccccactgatgggaccagagagagtgaaagagaaaagaaaactcagaaagggatgaatctgaactatatgattacttgtagtcagaatttgccaaagcaaatatttcaaaatcaactgactagtgcaggaggctgttgattggctcttgactgtgatgcccgcaattctcaaaggaggactaaggaccggcactgtggagcaccctggctttgccactcgccggagcatcaatgccgctgcctctggaggagcccttggattttctccatgcactgtgaacttctgtggcttcagttctcatgctgcctcttccaaaaggggacacagaagcactggctgctgctacagaccgcaaaagcagaaagtttcgtgaaaatgtccatctttgggaaattttctaccctgctcttgagcctgataacccatgccaggtcttatagattcctgatctagaacctttccaggcaatctcagacctaatttccttctgttctccttgttctgttctgggccagtgaaggtccttgttctgattttgaaacgatctgcaggtcttgccagtgaacccctggacaactgaccacacccacaaggcatccaaagtctgttggcttccaatccatttctgtgtcctgctggaggttttaacctagacaaggattccgcttattccttggtatggtgacagtgtctctccatggcctgagcagggagattataacagctgggttcgcaggagccagccttggccctgttgtaggcttgttctgttgagtggcacttgctttgggtccaccgtctgtctgctccctagaaaatgggctggttcttttggccctcttctttctgaggcccactttattctgaggaatacagtgagcagatatgggcagcagccaggtagggcaaaggggtgaagcgcaggccttgctggaaggctatttacttccatgcttctccttttcttactctatagtggcaacattttaaaagcttttaacttagagattaggctgaaaaaaataagtaatggaattcacctttgcatcttttgtgtctttcttatcatgatttggcaaaatgcatcacctttgaaaatatttcacatattggaaaagtgctttttaatgtgtatatgaagcattaattacttgtcactttctttaccctgtctcaatattttaagtgtgtgcaattaaagatcaaatagatacatt

SEQ ID NO: 802 - DNA, 1620 bp, Homo sapiens
cagcctcctcacagctccccatagcctggacctgccggccctccctccaggaccgaggggctcccaagggaaactcaggcgtgtgctggtcccaatgtcagtgaaacccagctgggggcctggcccctcggagggggtcaccgcagtgcctaccagtgaccttggagagatccacaactggaccgagctgcttgacctcttcaaccacactttgtctgagtgccacgtggagctcagccagagcaccaagcgcgtggtcctctttgccctctacctggccatgtttgtggttgggctggtggagaacctcctggtgatatgcgtcaactggcgcggctcaggccgggcagggctgatgaacctctacatcctcaacatggccatcgcggacctgggcattgtcctgtctctgcccgtgtggatgctggaggtcacgctggactacacctggctctggggcagcttctcctgccgcttcactcactacttctactttgtcaacatgtatagcagcatcttcttcctggtgtgcctcagtgtcgaccgctatgtcaccctcaccagcgcctccccctcctggcagcgttaccagcaccgagtgcggcgggccatgtgtgcaggcatctgggtcctctcggccatcatcccgctgcctgaggtggtccacatccagctggtggagggccctgagcccatgtgcctcttcatggcaccttttgaaacgtacagcacctgggccctggcggtggccctgtccaccaccatcctgggcttcctgctgcccttccctctcatcacagtcttcaatgtgctgacagcctgccggctgcggcagccaggacaacccaagagccggcgccactgcctgctgctgtgcgcctacgtggccgtctttgtcatgtgctggctgccctatcatgtgaccctgctgctgctcacactgcatgggacccacatctccctccactgccacctggtccacctgctctacttcttctatgatgtcattgactgcttctccatgctgcactgtgtcatcaaccccatcctttacaactttctcagcccacacttccggggccggctcctgaatgctgtagtccattaccttcctaaggaccagaccaaggcgggcacatgcgcctcctcttcctcctgttccacccagcattccatcatcatcaccaagggtgatagccagcctgctgcagcagccccccaccctgagccaagcctgagctttcaggcacaccatttgcttccaaatacttcccccatctctcccactcagcctcttacacccagctgaggtagaggccagactcctccaacagtgaaggaaaaggcacaggtgagagtataggtgggagatttggggggatgtagaggggagggtcaaagcactcgtggtcaattttgaatctatcttaaaatactgaggtgtggagagagagacaggatcaggagcgatagagagcaggccctcagtgttgtactatttgtctcggtccttgtgtctaaggagcaatgcagaaaaaaaggtgaaataaatggaagagatagccatggaaaaaaaaaaaaaaaaaaaaaaaaaaaaaaaaaaaaaaaaaaaaaaaaaaa

SEQ ID NO: 803 - DNA, 3652 bp, Homo sapiens
gggaggggtgcgaggctagccacgcaggcggggccctgggtcattttaaactctcagagtgaacgtcttgataggaccgacaagacgcatgacatgtacttagaaagcttatcttagagccacactgagattggaacccgcaaaatatgccagggaggaaggtgagcaagggacacgacactcacccggagaaacccagcaagcgcagcgaggctgtggggagaccggagccctgcacaccgccgggggaaggtgggccagcgccaccaccgtggagaacagcgcggaggcaccccacgagatgagacggaactgccgtgagatccagcaatgccaactgtgggtctgacccaggagaacggaaagcagggacgtgaacagccctcctcatgttcttgacaccgtcattctcagcagctcagctaaggcacagaggcagccgagcgtctgtcagcggagtcgtggctgagcagaacacgccacacgccacacgccacacgccacacgtgcaggattgctcaagatggaagggcacagtggaatatatatatatatttatatttttggcgagaccctggaggacacactgaatacaatggaataccatcccgcctttgaaaggaagggaaatcctggcacacgctgcaacaggagggagcttgaggacactgtggtgagtggagcacgtgagacacggaaggacacacgctgaagacacgcagagatgcccacccacgtggggaggtgacaggggagcccagcgcacagagacaaagtggaatggaggcctgggggctgggagcaaatgcggagcgagtgcttcctggggcagagtctccgtttgggaagatgagaaggttctgccgacggatgctggcgatggttgcagaagaatgtgaatgtgcccaatgctactgaaaaacggttacaatggaaacgccaccccagtgaccaccactgccccgtgggcctccctgggcctctccgccaagacctgcaacaacgtgtccttcgaagagagcaggatagtcctggtcgtggtgtacagcgcggtgtgcacgctgggggtgccggccaactgcctgactgcgtggctggcgctgctgcaggtactgcagggcaacgtgctggccgtctacctgctctgcctggcactctgcgagctgctgtacacaggcacgctgccactctgggtcatctatatccgcaaccagcaccgctggaccctaggcctgctggcctgcaaggtgaccgcctacatcttcttctgcaacatctacgtcagcatcctcttcctgtgctgcatctcctgcgaccgcttcgtggccgtggtgtacgcgctggagagtcggggccgccgccgccggaggaccgccatcctcatctccgcctgcatcttcatcctcgtcgggatcgttcactacccggtgttccagacggaagacaaggagacctgctttgacatgctgcagatggacagcaggattgccgggtactactacgccaggttcaccgttggctttgccatccctctctccatcatcgccttcaccaaccaccggattttcaggagcatcaagcagagcatgggcttaagcgctgcccagaaggccaaggtgaagcactcggccatcgcggtggttgtcatcttcctagtctgcttcgccccgtaccacctggttctcctcgtcaaagccgctgccttttcctactacagaggagacaggaacgccatgtgcggcttggaggaaaggctgtacacagcctctgtggtgtttctgtgcctgtccacggtgaacggcgtggctgaccccattatctacgtgctggccacggaccattcccgccaagaagtgtccagaatccataaggggtggaaagagtggtccatgaagacagacgtcaccaggctcacccacagcagggacaccgaggagctgcagtcgcccgtggcccttgcagaccactacaccttctccaggcccgtgcacccaccagggtcaccatgccctgcaaagaggctgattgaggagtcctgctgagcccactgtgtggcagggggatggcaggttgggggtcctggggccagcaatgtggttcctgtgcactgagcccaccagccacagtgcccatgtcccctctggaagacaaactaccaatttctcgttcctgaagccactccctccgtgaccactggccccaggctttcccacatggaaggtggctgcatgccaaggggaggagcgacacctccaggcttccgggagcccagagagcatgtggcaggcagtggggcctcttcatcagcagcctgcctggctggctcccttggctgtgggcaggtagcacgcctgctggcagaggtacctggtggctgccctgttcgcatcagtggcgatgactttatttgcggagcatttctgcaagcgttgcctggatgcggtggtgcattgtgggccctctgggctcctgcctcagaatgtcagtgagcaccatgctggaggtcacccagcactgtggcagcgcccaggagggcatagggcagcctaccacctccaagggggcaggcgccctcatctggggttgggtctgtgctgagctggagggcctctagggaaccgtggggcagggtggccagctgctggctcccagagcgcagcccaggcgtcctcaacggggagccccaaatgtccacgcccagaacaacagttggcaggacaggtgtgacacagccacagcagaggcaaggggtgccaggagtccccagcggcatcctcggggagatgctggtgaggggtccgtacagggtggggtccccacccctagccccttactgaggggggagtgcagcagttggcctgcttgtctggcggagaaagccagctccctgcaccctcggggctgagtcagatctgggtctgccgcaaaggccttgcctagaccaggtcacactgatgccctggtttccctatctgtaaaatggggccaatgacacctacctcactgggtcaccatcgagatcaatcctcctccctgccccgacacctcgggcacatcgcatgcactcagagcacagagccgggcagacgcagcacctgcatggggagcccagtgcccggcacagcacaggggcttccagggaggccgcgcagggccgtggggctgagccacgctctcgttttgtcaggcagctatgcagttgctcttccttgtttttgttttgtttttgtttttgtttttaatatttatttttttagagacagggccttgctctgttgcctgggctggagaacagtggcaccatcatagctcactgcagcctcaaactcctgggctcaagcgatcctccccgctcagcctcctgagtagctgggactacaggtgtgcaccaccacacccagccaaaacagccatcctccccttgagagtcatcagaaaaatacattaggaaaatgtgtttagaaataaaagcacaaggcagggcagtgctcacgcctgtcatcccagcactttgggaggccgagacgggaggatcagttgaggtcaggagtttgagaccagcctcggcaacatggcaaaatcttgtctcttttttttggtattaaaaaaatcataaaaataaaagaaataatgcaaaaaaaaaaaaaaaaaa

SEQ ID NO: 804 - DNA, 2714 bp, Homo sapiens
gggtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtcaaaaaaaaaaaaaaaa

SEQ ID NO: 805 - DNA, 6885 bp, Homo sapiens
atgccaagaactggagctcaggatggagcatggatccaaaagcaggttgtttttgaaggtcaaatggcttcaacgtatgaacaggatgaagtcattgctattgatgatatatctttcagttcaggctgcttgcctgccaatgatggaattttactgtgtcaagaagcattgaatgctgagcgggagctatgccatccagatacagatctctgcagatttgatgctacagatgaagagttgagattgtgtcaggcctgtgggtttgaatttgacatgtgtgagtggacgtcagaagcatctgctggccaaatttcctggatgcgcacaaaagcgagagagatccctgcattcgaatccacacctcagcaggatcaaggaggtgatgatgaaggttattatgtatgggtaggcgctaagcatggtttcactcttaaccatttagacagcagggcttacctaaatagctctgtgtgtcattgcctgggcaagagctgtcatcttcaattctattatgcaatggaaagcagtgtcctgagagtaagactgtataataataagatgcgatcaaaagtagtgaaactcaacaacattgactttggtacccttgatttcttcactggaagagaaaagcatagactggcatctctaagagatagagtgttaataaatatgttaaatatttttcttgaaagctttttcaattttactaccaagactttagatttcctagtactttatatcatacaggaagaagaaatattttggacatacaacatatcaactcacagccaatgggtgaaagcagatgtgttaataccagaagatctgaagacatttaagattatttttgaagggactcttttgagccagagaagttttattgcccttgatcacctctgggtctatgcctgtggacagacccaatccagaaagctttgctctgcagacgaattcccttgcactagtggccagtgcatcgccaaagaatctgtctgtgactctcggcaggactgctccgatgagagtgatgaagacccagcaacttgctcaaagcatctcacctgtgactttgagtcgggtttctgcggttgggagccatttctcacagaagattcacactggaagctgatgaaaggattgaataatggagagcaccactttcctgcagctgatcacacagcaaacataaatcatggatcgtttatttatttggaggcacagcgctcccccggggtggccaagcttggaagtcctgttcttacaaaattgctcactgcctctaccccatgtcaggtgcagttttggtatcatttgtctcaacattcaaatctctcagtttttacaagaacgtctctagatggaaacttgcaaaagcagggcaaaataatcagattctccgaatctcagtggagccacgcaaaaattgatctcattgcagaagcgggagaatctactctaccttttcagttaattttggaagctactgttttgtcgtcaaatgctaccgttgctctagatgacatcagtgtgtcccaggaatgtgaaatttcctataaatcactaccaaggaccagtacacaaagcaagttttccaagtgtgactttgaagcaaacagctgtgattggtttgaagcaattagtggtgaccattttgactggatacggagctctcagagtgaactttctgctgattttgagcaccaggctccacctcgggatcatagtctcaacgcatctcaagggcattttatgttcattctgaagaaaagcagcagcttgtggcaagttgctaagcttcagagcccaactttcagccagacaggacctggatgcatactttccttctggttctataactatggcctgtcagtgggagcagctgagctgcagctacatatggaaaattctcatgactcaacagtgatttggagagtattatacaatcagggcaaacaatggttggaggcaaccattcagctagggcgcctttcgcagcccttccatttgtcactagataaagtcagtctgggcatttatgatggggtctcagctattgatgacatccgatttgaaaattgtactctccctcttcctgctgagagctgtgaagggctggatcatttctggtgtcgccacaccagggcttgcatagaaaagcttcggttatgtgatctggtggatgactgtggtgatcgtactgatgaagtcaactgtgcacctgagctgcagtgtaactttgaaactggaatctgtaactgggaacaagatgcaaaagatgactttgattggaccaggagccagggtccaactccaacacttaacacagggccaatgaaagataacactctgggcacagctaaaggacactatctctacatagaatcttcagagccacaggcttttcaagacagtgctgccttactcagcccaatccttaatgccactgatacaaaaggctgcaccttccgcttctattaccacatgtttggaaagcgcatttataggttggcaatctaccaacgaatctggagtgactcaaggggacagctgctgtggcagatatttgggaatcaaggcaacagatggattaggaaacacctcaacatttccagcaggcagccctttcagatattggtggaggcttcagtgggagatggcttcactggagatattgcgattgatgatctgtcatttatggactgcaccctctaccctggtaatttgccagcagacctcccaactccaccagaaacgtcagttcctgtaacattacctccacacaactgcacagacaatgaatttatctgcaggtctgatggtcactgcattgaaaaaatgcagaaatgtgattttaaatatgactgccctgacaaatcagatgaagcatcctgtgttatggaagtttgcagctttgagaaaagaagcctgtgtaaatggtatcaaccaatcccagtacatttgcttcaagattcaaacacattcaggtgggggcttgggaacgggatcagcattcatcatggggaagaaaaccacaggccatcagtggatcatacacaaaataccactgatggctggtacctgtatgctgacagttctaatgggaaatttggtgacacggctgacattctcactcctatcatttcactcacgggaccaaaatgtaccttggtgttctggacacatatgaatggggccaccgttggttctctccaggtgctcatcaagaaagataacgttacttctaaattgtgggctcaaactggacagcaaggtgcacagtggaagagagcagaagtgtttttaggcattcgttcacatacacaggtgtgtaatacaggtagttatgggattgtcttcagagccaaacgtggtatcagttacataggagatgtagcagtggatgatatttccttccaagattgctcccctttgcttagcccagagagaaagtgtactgatcatgaattcatgtgtgctaataagcactgcattgccaaagacaagctgtgtgattttgtgaatgattgtgctgataattcagatgagactactttcatttgccgtacctccagtgggcgctgtgatttcgaatttgatctttgttcctggaagcaggagaaagatgaggactttgactggaacctgaaagctagcagcatccctgcagcaggcacagagccagcagcagatcacactttgggaaattcatctggtcattacatctttataaagagtttgtttcctcagcagcccatgagagctgccagaatttcaagtccagttataagtaagagaagcaaaaactgcaagattatttttcattatcacatgtatggaaatggcattggggcactcaccttaatgcaggtgtcagtcacaaaccaaacgaaggttctacttaacctcactgtagaacaaggcaatttctggcggagagaagaactgtcactgtttggtgatgaagacttccaactcaaatttgaaggtagagttgggaaaggtcagcgtggagacattgcacttgatgacattgtgcttacagaaaattgtctatcactccatgattccgtgcaagaagaactggcagtgcctcttccaacaggtttctgcccacttggctatagggaatgtcataatggaaaatgctataggctggaacaaagctgtaacttcgtagataactgtggagataatactgatgaaaatgagtgtggtagctcctgtacttttgaaaaaggctggtgtggctggcaaaactcccaggctgacaactttgattgggttttaggggttggctctcatcaaagcttaagacctcccaaagaccacacacttggaaatgaaaatgctatcttgttgatgcgacggcataaatatcccatcagatcagttaatctgcatactgtgaagcacgtgctaaaagcacagacagttggaaattgttctgtcagcaagctagaggcgaggctattagattttctttctgttccaaatgaaaatacttttggcagctcagatcatacgaattggcacttcatgtatctggaagctactgcagtgggccttcggggtgacaaagcacacttcaggagtaccatgtggcgagaatccagtgcagcctgcaccatgagcttctggtatttcgtatctgcaaaggccacaggatccattcagattctcatcaagacagagaaaggactatcaaaagtatggcaagaaagtaagcagaaccctggtaatcattggcaaaaggctgacatcctgctaggaaagttaaggaattttgaagtcatatttcaaggtatcagaacaagggacctgggaggaggagctgcaattgatgatattgaatttaaaaactgcacaactgattgggggatgatgggtcggaaaagtgaagaaacaattgtggaagccatccttggggagagtaaggtccaaggatctcagcacgggggcggaggagaaggcgggctcccaatccggttctatccggttctcccaccatcccccgccaggggtctcagcagctcggagggtggaggggcggcagcgccaggcaccgcgcacgcgcctttccggagccagaatgcccaagaggaagtgggagagatctctgagctttgtccggaaatcactgattttttgtgccgggacaagaagtgcattgcatcccaccttctttgtgactataagccagactgctctgatagggtagtagcaaatgtgatagacatttccagaaattccattaatgtttttgcttccccagcacattatacaagcacaacaggaagctgcaattttgaaacaagttcaggaaactggaccacagcctgcagtcttactcaagactctgaggatgacttggactgggccattggcagcagaattcctgccaaagcattaattccagactctgatcacacgccaggtagtggtcagcacttcctgtacgtcaactcatctggctccaaggaaggatccgttgccagaattactacttccaaatccttcccagcaagccttggaatgtgtactgttcggttctggttctacatgattgatcccaggagtatgggaatattaaaggtgtataccattgaagaatcggggctaaacatcctggtgtggtcagtgattggaaataaaagaacgggatggacatatggctctgtgcctctctccagtaacagtccgtttaaggtggcatttgaagctgatttggatggaaatgaggacatctttattgctcttgatgacatctcttttaccccagagtgtgtgactggaggtcctgtcccagtgcagccatcaccctgtgaagctgatcagttttcttgtatctacacactccaatgtgtccctctctcagggaaatgtgatggacatgaagactgcatagatggatctgatgaaatggattgtcctctcagccccacccctccactctgtagtaacatggagttcccgtgctctacagacgagtgtataccttccctcctgctatgcgatggagtgcccgactgccactttaatgaagatgagctcatctgctccaacaaaagctgttctaatggagctctggtgtgtgcctcctccaacagctgtatcccagcccaccagcgctgtgatggttttgccgactgcatggatttccagcttgatgagtccagctgctccgccgcggcggcagcggcggggaccacgctgcggtgcaccaccttccgccaccctcccgcgctgggctggggtcgagggggcttcgcagagtcggtaaccgaaccggctctgggagaccccgccagggtcggggcggggcgcgatcgccccccgcagtcgggcgcgaaggcggcccgggagccaggtgggtgtggggcgcagttggcggagctgcccagggcgtgcgagcaggctgcgaggatggcgccccggcggcgcggaggtaccgccccgcgctcccccgatagctccccggcctgtcccctctccccgcgctctggggcagccggctgcctggggcgcacggggctggagtggccctctccctccccttcgctaggctcccccggcttaatctgttggccgcgactcctcagccagccccgaggaaagtgcagccattggacaggtctgtgcgggctgccggtttcagggaggaaggtgggagaagcctggaggagcgaaggggagggcggagggaggagggaggagggtgcggcggcagatctggcaaattgcgagctgccttccctcctcaaagtgtggagaaggagcgcgggggagcgtggcgacggcagcgcctcctccgccaccaaactcctggggctccgcgggggcttggggccacctcctcctgagcccggaggaaccctctcccgatag

SEQ ID NO: 806 - DNA, 2663 bp, Homo sapiens
atgggcctggggcctgcctgggtcacacagccttgcctggtcactgactcccagcctgatgcggaattactctcctcaagagcaccctgcctaggtcggcggtgctgctggtccccgggcagaggaggcgtgggcggctccgggaccacggagcctggtgacgcggcgctcccctgcccgggtcgggttgcccaggcgccgccgcggcggctgctgctgctgctgccgctgctgctgggtaggggacttcgagtaacggccgaggcctcggcctcctcctctggggcggcggtcgagaacagcagcgccatggaggagctcgtcactgagaaggaggcggaagagagccaccggccagacagtgtgagcctgctcaccttcatcctgctgctcacgctggccatcctcaccatatggctcttcaagtactgccgggtgcactttctgcatgagaccgggctggccatgatctgtgggctcatcgttggggtgatcctgaggtatggtacccctggcaccaggggccgtgacaaattactcaattgcactcaagaagatcaggccttcagcactttagtagtggatgtcagcggtaaattcttcgaatacaccctgaaaagagaaatcagccctggcaagatcaacagcgtaaagcagaatgacatgctagggaaggtaacattcgacccataggtatttttcaacattcttctgcctccagttattttccatgctggatacagcttaaagagacacttttttagaaatcttgggtcactccttcttggggactgctgtttcgtgcttccgtattggaaatctcaggtatggtatggtgaagctcatgaggattatgagacagctctcagataaattttactacacacattgtctcttttttagagcaatcatctctgccactgacccagtgactgtgctggtgatatcaatgaattgcatgcagacatggatctttatgtacttctgtttggagagagcatcctaaatgacgttgttatgttgtactttcctcatctattgttggctaccagccagcaggactgaacttcaactcacgcctttgatgctgctgcctttttaaagtcagttggcatttttctaggtatatttagtggctgttttaccatgggagctgtgactggtgttgtgactgctttagtgaccaagtttaccaaactggactgctttcccctgctggagacggcgctcttcttcctcatgtcctggagcacgtttctcttggcagaagcttgcggatttacaggcgttgtagctgtccttttctgtggaatcacacaagctcattacaccttcaacaatctgtcggtggaatcaagaagtcgaagcaagcagctctttgaggcagagaacttcatcttctcctgcatgatcctggcgctatttaccttccagaagcacgttttcagccctgttttcatcattggagcttttgttgctgtcttcctgggcagagccgcccatatctacccgctctctttcttcctcagcttgggcagaaggcataagattggctggaattttcaacacacgatgatgttttcaggcctcaggggagcaatggcatttgcgttggccatctgtgacacggcatcctatgctcgccagatgacgttccccaccacgcctttcatcgtgttcttcaccatctggatcattggaggaggcacgacacccatgttgtcatggcttaatatcagagttagcatcaaggagccctccaaagaggaccacaacgaacaccaccgacagtacttcagagttggtgttgaccctgatcaagatccaccacccaacaatgacagctttcaagtcttacaaggggacagcccagattctgccagaggaaactggacaaaacaggagagcacatggatattcaggcggtggtacagctttgatcacaattacctgaagcccatcctcacacacagcggctccccgctaaccaccactctcccgcctggtggagacacagcggctccccgctaaccaccactctcctgcctggtgtagacaaagcggctccccgccaaccaccactctcccgcctggtgtagcttgctagcttgatgtctgaccagtccccaggtgtacgataaccaagagccactgagagagggaaactctgattttattctgactgaaggcgacctcacattgacctatggggacagcacagtgactgcaaatggcttctcaggttcccacactgcctccacgagtctggagggcagctggagaatgaagagcagctcagaggaagtgctggagcaggacgtgggaatgggaaaccagaaggtttcgagccagggtacccgcctagtgtttcctctggaagataatgtttgactttccctgcaaaccctggcacgatggggtaggctcccaatggggtgaggatggcttcaagccctaatgttgcttgaggtggggcagtgactagattgaattaactcttctattttattggggtctgaagttattgtaacacttaaaatttaactcatgatgcagatggtgaggcaaaagtgtctctaaattcagacaaatgtagacctatttctactttttttcacacagtagtgcgctgtttcagagttaaacaaacaaaaaaatagcat

SEQ ID NO: 807 - DNA, 1518 bp, Homo sapiens
ggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggaaataagatatgtggaacggagttatgtatcaaaacccactttgaaggaagtggtcatagtaagtgctacaagaacacccattggatcttttttaggcagcctttccttgctgccagccactaagcttggttccattgcaattcagggagccattgaaaaggcagggattccaaaagaagaagtgaaagaagcatacatgggtaatgttctacaaggaggtgaaggacaagctcctacaaggcaggcagtattgggtgcaggcttacctatttctactccatgtaccaccataaacaaagtttgtgcttcaggaatgaaagccatcatgatggcctctcaaagtcttatgtgtggacatcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatgggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtcaaccagatgtagtggtgaaagaagatgaagaatataaacgtgttgattttagcaaagttccaaagctgaagacagttttccagaaagaaaatggcacagtaacagctgccaatgccagtacactgaatgatggagcagctgctctggttctcatgacggcagatgcagcgaagaggctcaatgttacaccactggcaagaatagtagcatttgctgacgctgctgtagaacctattgattttccaattgctcctgtatatgctgcatctatggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaaca

SEQ ID NO: 808 - DNA, 1758 bp, Homo sapiens
ctgctgtctgcggaggaaactgcatcgacggacggccgcccagctacgggaggacctggagtggcactgggcgcccgacggaccatccccgggacccgcctgcccctcggcgccccgccccgccgggccgctccccgtcgggttccccagccacagccttacctacgggctcctgactccgcaaggcttccagaagatgctcgaaccaccggccggggcctcggggcagcagtgagggaggcgtccagccccccactcagctcttctcctcctgtgccaggggctccccgggggatgagcatggtggttttccctcggagccccctggctcgggacgtctgagaagatgccggtcatgaggctgttcccttgcttcctgcagctcctggccgggctggcgctgcctgctgtgcccccccagcagtgggccttgtctgctgggaacggctcgtcagaggtggaagtggtacccttccaggaagtgtggggccgcagctactgccgggcgctggagaggctggtggacgtcgtgtccgagtaccccagcgaggtggagcacatgttcagcccatcctgtgtctccctgctgcgctgcaccggctgctgcggcgatgagaatctgcactgtgtgccggtggagacggccaatgtcaccatgcagctcctaaagatccgttctggggaccggccctcctacgtggagctgacgttctctcagcacgttcgctgcgaatgccggcctctgcgggagaagatgaagccggaaaggaggagacccaagggcagggggaagaggaggagagagaagcagagacccacagactgccacctgtgcggcgatgctgttccccggaggtaacccaccccttggaggagagagaccccgcacccggctcgtgtatttattaccgtcacactcttcagtgactcctgctggtacctgccctctatttattagccaactgtttccctgctgaatgcctcgctcccttcaagacgaggggcagggaaggacaggaccctcaggaattcagtgccttcaacaacgtgagagaaagagagaagccagccacagacccctgggagcttccgctttgaaagaagcaagacacgtggcctcgtgaggggcaagctaggccccagaggccctggaggtctccaggggcctgcagaaggaaagaagggggccctgctacctgttcttgggcctcaggctctgcacagacaagcagcccttgctttcggagctcctgtccaaagtagggatgcggatcctgctggggccgccacggcctggctggtgggaaggccggcagcgggcggaggggatccagccacttccccctcttcttctgaagatcagaacattcagctctggagaacagtggttgcctgggggcttttgccactccttgtcccccgtgatctcccctcacactttgccatttgcttgtactgggacattgttctttccggccaaggtgccaccaccctgccccccctaagagacacatacagagtgggccccgggctggagaaagagctgcctggatgagaaacagctcagccagtggggatgaggtcaccaggggaggagcctgtgcgtcccagctgaaggcagtggcaggggagcaggttccccaagggccctggcacccccacaagctgtccctgcagggccatctgactgccaagccagattctcttgaataaagtattctagtgtggaaaaaaaaaaaaaaaaaaaaaaaaaaaaaa

SEQ ID NO: 809 - DNA, 1927 bp, Homo sapiens
agtgtgcctctgtcctttgccacaaacatgaggttcacattccctctcatggctatagtcctggaaattgccatgattgttttatttggattatttgttgagtatgaaacggaccagactgttctcgagcagctcaacatcaccaagccaacagacatgggcatattctttgagttatatcctctgttccaagatgtacatgttatgatatttgttgggtttggcttcctcatgaccttcctgaagaaatatggcttcagcagtgtgggtatcaacctactcgttgctgctttgggcctccagtggggcactattgtacagggaatcctgcaaagccagggacagaaatttaacattggaatcaaaaacatgataaatgcagacttcagtgcagccacagttctgatatcttttggagctgtcctgggaaaaacgagccccacccaaatgctgatcatgacaattttagaaattgttttctttgcccacaatgaatacctggttagtgaaatatttaaggcctctgacattggagcatcaatgacgatccatgcctttggggcctactttggcttggctgtagcaggcatcttgtatcgatctggactgagaaaggggcatgaaaatgaagagtccgcatactactcagacttgtttgcaatgattgggactctctttctgtggatgttttggcccagctttaactcggccattgctgaacctggagacaaacagtgcagggccattgtagacacgtacttctctctcgctgcctgtgtgctcacagcctttgccttctccagcctagtggagcaccgaggcaagctcaacatggttcacattcagaatgccacccttgctggaggagttgctgtgggcacttgtgcggatatggcaattcacccatttggttctatgattattgggagcattgcaggaatggtctctgtgcttggatacaagttcctgactccactttttactactaaactgaggatccatgatacatgtggggtccataacctccacggcttacctggtgtagtgggaggccttgcaggcattgtggcagtagcaatgggcgcctccaacacgtctatggccatgcaggcagctgcactgggttcctctatcggaacagcagttgttggaggtctgatgacaggtttaattctaaagttgcctctctggggacagccatctgaccagaactgctatgatgattctgtttattggaaggtccctaagacgagataacttgacaatcagttccatggacatggtgaccacagccagctggaacctgaagtctaaacaccattcctgctctccagcttcctttcccattatccagaatcaagtccaaataaacaaaaagggagtaaccaaagagagtatggaccagagtgaatagatcctaagtcccaaatggccagtgtaaaaatgtccttatgtctgatgctgtctcttgctcttcaatgattaattgaggggatgttactcataaaacagataatcaaatagatcttctccaggattcccaaaaagcttttggcagtgagtaaatacagagtaaacatgtcagtttcttaatgtagacactatgtcttcaatcccaaaaattataaaactgaaacccatgaagcaagaatagatgtgagaaatctatgtaaaaaaataattaaagaaatgcatgtgtgtaaagtagtaatatgatgattttaggtagtgctttttattttaaaaatagtctagttagtaatgttgtatccttgcatgaatattattcttaattccttttgcatgttgactatttgcaacgagctcaaatgctatctgatcaaagtctattttgcataaaatgtccaataattaaatattgttataaaataaaaaaaaaaaaaaaaaaaaaaaaaaaaaaaaaaaa

SEQ ID NO: 810 - DNA, 2445 bp, Homo sapiens
aggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagaaaaaaaaaaaaaaaaaaa

SEQ ID NO: 811 - DNA, 3010 bp, Homo sapiens
cgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaagaacctaaggtggaaacactgtcctctcatcttgggaccgagggggtggggaagttccccaacacataatcccaagactgtgcccctcatctgcatcttcagatccagtactctgtgtacctgctccagccccacccccacagagagaacttgtggctctggggctggggtgagggctggtggttggtgaaagccattcttagttgtgtctctgcaatgctgtgggcacaaaagaaggggcaccagagtccctgtgcaaacacctagactcacttcatggattccaaagctctcagcttcattttattagttacgttaggtaagggggttcaagggtcatggtcctcatcacacacatgtcatcagggccctctgcactccacatgatgaggtcagacccacacggtgcaaatctttgggtcagtgagctcctggagaagagaggagacatgtcaggaatagattaggcacccctcttccttaatgaaatgtggcagtcctctcaggggtaccccacctacttagggatctgagttcttcagttcctcacccatagctcagcccgggctccctgatttggtcttcaatctactattcattccgtccccacccttttcttcttgatcttcctcagaccctttcccaaacccctctccctggg

SEQ ID NO: 812 - DNA, 3489 bp, Homo sapiens
gtgacctgcttagagagaagcggtgggtctgcacctggattttggagtcccagtgctgctgcagctctgagcattcccacgtcaccagagaagccggtgggcaatgagatcatgtctgctttcaggttgtggcctggcctgctgatcatgttgggttctctctgccatagaggttcaccgtgtggcctttcaacacacgtagaaataggacacagagctctggagtttcttcagcttcacaatgggcgtgttaactacagagagctgttactagaacaccaggatgcgtatcaggctggaatcgtgtttcctgattgtttttaccctagcatctgcaaaggaggaaaattccatgatgtgtctgagagcactcactggactccgtttcttaatgcaagcgttcattatatccgagagaactatccccttccctgggagaaggacacagagaaactggtagctttcttgtttggaattacttctcacatggcggcagatgtcagctggcatagtctgggccttgaacaaggattccttaggaccatgggagctattgattttcacggctcctattcagaggctcattcggctggtgattttggaggagatgtgttgagccagtttgaatttaattttaattaccttgcacgacgctggtatgtgccagtcaaagatctactgggaatttatgagaaactgtatggtcgaaaagtcatcaccgaaaatgtaatcgttgattgttcacatatccagttcttagaaatgtatggtgagatgctagctgtttccaagttatatcccacttactctacaaagtccccgtttttggtggaacaattccaagagtattttcttggaggactggatgatatggcattttggtccactaatatttaccatctaacaagcttcatgttggagaatgggaccagtgactgcaacctgcctgagaaccctctgttcattgcatgtggcggccagcaaaaccacacccagggctcaaaaatgcagaaaaatgattttcacagaaatttgactacatccctaactgaaagtgttgacaggaatataaactatactgaaagaggagtgttctttagtgtaaattcctggaccccggattccatgtcctttatctacaaggctttggaaaggaacataaggacaatgttcataggtggctctcagttgtcacaaaagcacgtctccagccccttagcatcttacttcttgtcatttccttatgcgaggcttggctgggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccagccctcaggtcggtttggctcggccttggctgtgttggactttaacgtggacggcgtgcctgacctggccgtgggagctccctcggtgggctccgagcagctcacctacaaaggtgccgtgtatgtctactttggttccaaacaaggaggaatgtcttcttcccctaacatcaccatttcttgccaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggctgggccatttgttacacatccgagatgagaaaaagagccttgggagggtgtatggctacttcccaccaaacggccaaagctggtttaccatttctggagacaaggcaatggggaaactgggtacttccctttccagtggccacgtactgatgaatgggactctgaaacaagtgctgctggttggagcccctacgtacgatgacgtgtctaaggtggcattcctgaccgtgaccctacaccaaggcggagccactcgcatgtacgcactcacatctgacgcgcagcctctgctgctcagcaccttcagcggagaccgccgcttctcccgatttggtggcgttctgcacttgagtgacctggatgatgatggcttagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggcccaatatgtattgatttctcctgaagccagctcaaggtttgggagctccctcatcaccgtgaggtccaaggcaaagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccaatggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatac

SEQ ID NO: 813 - DNA, 2140 bp, Homo sapiens
cgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcaaaaaaaaaa

SEQ ID NO: 814 - DNA, 2249 bp, Homo sapiens
cgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagagcagtgtgtggattacactatcactggaaaaatacgaattgagaagaaggaaaagactggaagatgcagaccttggttcctgttagtggaaacactgtaaggtcccagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcaaaaaaaaaa

SEQ ID NO: 815 - DNA, 4221 bp, Homo sapiens
gtcggccgtcccctttaatttttaaatacacggtcccctcttttctctggggggggcaagcaagaaatcaaagaaggaggagacaagccgtcaattttctccaaaacaaaccccaccgggcaatttggtctcggggtagggggagacggggtgattgcaaattattccaggacgagatccagttctccagcgggaaaggggcaaaggaacgccgcgcgttggaagggccagggtacgcagctccccttgcagcgcccgcaggacccccgcaagctcgtgccggcgaaatcggagaccgccgatctgtcctcgttctctcctgcacgtctggctgcattcggaggaagacctggggcgcgagcgagcggcgacagcatgagcctgtgctgacctccgcgcggcgggccgagcccagggctttgtcgcggtacctgcgcccagcccgcgccgcaactctgtgcccagcttttgcaatcttttgttgcagcgctgaccgcaccaagttaaatgctcccttgcaatttttcttttttttgtttgtttgtttaatttttggagagctcgcgatcttggaaaagcctcagacgccatctacagttaaaacgtaggtaactgccctctcccgcaccccccccttacacgccccccaccctttccaccaaaaaaagggggtgcagcgcggattctggctgccgtgcgtcgccagccggtagacccgtgcttgtttcctttctctttttgtttggcttctaacgcgttgggactgagtcgccgccgtgagctccccgaagactgcacaaactaccgcgggctcctccgccccgtctgcgattcggaagccggcctgggggtcgcgtcgggagccctgcgctgcagctccgcaccttagcagcccgggtactcatccagatccacgccggggacacacacacagagtaactaaaagtgcggcgattctgcacatcgccgactgctttggggtaacaaaaagacccgagttgcctgccgaccgaggacccccgggagccgggctcggagcagacgaggtatccggcggcgcccatttgggggcttctaactctttctccacgcagcccctcttctgtcccctcccctctcgctcccttttaaaatcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttattgttggaacctctggagggagaccacgtttttcgtgccgtgcatctgcacagcggagaggagctggtgtgcaaggtgtttgatatcagctgctaccaggaatccctggcaccgtgcttttgcctgtctgctcatagtaacatcaaccaaatcactgaaattatcctgggtgagaccaaagcctatgtgttctttgagcgaagctatggggacatgcattccttcgtccgcacctgcaagaagctgagagaggaggaggcagccagactgttctaccagattgcctcggcagtggcccactgccatgacggggggctggtgctgcgggacctcaagctgcggaaattcatctttaaggacgaagagaggactcgggtcaagctggaaagcctggaagacgcctacattctgcggggagatgatgattccctctccgacaagcatggctgcccggcttacgtaagcccagagatcttgaacaccagtggcagctactcgggcaaagcagccgacgtgtggagcctgggggtgatgctgtacaccatgttggtggggcggtaccctttccatgacattgaacccagctccctcttcagcaagatccggcgtggccagttcaacattccagagactctgtcgcccaaggccaagtgcctcatccgaagcattctgcgtcgggagccctcagagcggctgacctcgcaggaaattctggaccatccttggttttctacagattttagcgtctcgaattcagcatatggtgctaaggaagtgtctgaccagctggtgccggacgtcaacatggaagagaacttggaccctttctttaactgagctcatgccccacggagacttagcaggttccaggagtgagcgagggcagcggaaaggagttcttccgggggacacgaattgcctggctgagtagcaagaaagacacactcttaagtttcttggttcagagcaggaaaaccttcaaggagctgactgaccacgtagcatgggggcaagaggcgtgggatggggattggggtgagatggatgggagcccgctggagcttgtcttccctaacatagcctgggagaccaccccttgccacttgggccacttccgcctaccccacttttcattttgttccaaaatagttgcagatcctgacagaatcaaaactctctgcctcaaacacacatcctggcatcgcactgttagcatttaacttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaataaactatttaatatcctggtcaggaaatgacatgttaatgctttgctccctgaagggggaaaaaatctgtcctttaacaagctattctgttttgtgtcaattgggtccgtggcaaggaagctattaggaagtcaaacggtccaggatgcattacctgctaatccttaggtttaaagggggaaagaaaagggaagaagaaaggaaaagagaaatccaactcctttttcatgttttgcttttgaacaatgagggtttgtgtgacaggcattcctctttgctgagatgatagcaatggcctgagattttagcaagctcctggagtctgatgcttttgcagtactctgatcgcaactaaacatttgtctttgttttattagaaactagtgaaacaaagcaggttgtcccacatgtataaaatacagggcagctatttagttttctttacagagaatgatccttttaaggcttgtaaggccctctggtttggacaaaaaccctcagtagagacaagcgggaaggataattagctgaaagctatgatgatataaataaaaacagctctctatcccaatacgcacctttgtattttcaagaactcttctatttattaaggaaaatgtcacattgtgatgtattaagccagtacttcaattacgggttgacttgggatgacatattacatgctgtagttaacatttataattctttttccttgtttgagtatttctgtctctgaaataaccttttacttggcttttctagatagctttatttgatttcgagtggcaaaatgttttttattacggcttttctattgctgtatgatacagaactcttttggcataaatatttgtgttcccagtacctcacttgttcggatttgactgcctgtatatgttttgtgaaatggtcctgtttttgggtaggtgacacgtggactctagtatgtaaatgttacttgaatctgtgcttcataatagtgtgtggcatgtatgtgcagactcttggatgctttatgcctgcgcaccaggagccctgtcctcacgttcccaggagggcggcttcacccttcgtaaccaggagacaaggcggccatggatttgcccttgattctattttgctaatggaagatagaaaggagagaaggtttttttttttttttaacattctgaagatggtgctgtgtcaagaaggaccttttttttcccctctcccctattttttaagtaccttggaggaggagaggttggtgacatgcatggtggggatctatggcctctggtgctttgtcctgtatttggtttaatgtttttgtcctaatctcttcaatcaataaaattgtgcgtatttaactaaaaaaaaaaaaaaaaaa

SEQ ID NO: 816 - DNA, 3929 bp, Homo sapiens
ctaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgtggatagaggtggaactcgttctattctcaaaacacactttgagaaagaagatttagaaggtcatcgaacactatttattggagtacatgtgcccttgggaggaagaaaaagccatcgacgtcacaggcatcgtggtcataaacacagaaagagagacagagaaagagattcaggattagaggatggaagggagtcaccttcttttgacaccccatcacagagggtacagtttattcttggaaccgaggatgatgacgaggaacacattcctcatgaccttttcacagaactggatgagatttgttggcgtgaaggtgaggacgctgagtggcgagaaacagccaggtggttgaagtttgaagaagatgtggaagatggaggagaaaggtggagcaagccttatgtggctactctttcattgcacagcttgtttgaattgagaagttgtattctgaatggaactgtgttgctggacatgcatgccaacactttagaagaaattgcagatatggttcttgaccaacaagtgagctcaggtcagctgaatgaagatgtacgccatagggtccatgaggcattgatgaaacagcatcatcatcagaatcagaaaaaactcaccaacaggattcccattgttcgttcctttgctgatattggcaagaaacagtcagaaccaaattccatggacaaaaatgcaggtcaggttgtttctcctcagtctgctccagcctgtgttgaaaataaaaatgatgttagcagagaaaacagcactgttgactttagcaaggttgatctgcattttatgaaaaagattcctccaggtgctgaagcatcgaacatcttactgggagaactggagttcttggatcgaacagtagttgcgtttgtcaggttgtctccagctgtattgcttcaaggactggctgaagtcccaatcccaaccagatttttgttcattcttctgggacccctgggaaagggtcaacagtaccatgagattggcagatcaattgcaaccctaatgacagatgaggtatttcatgatgttgcctataaagctaaagatcgtaatgacttggtatcaggaattgatgagtttctggatcaggttactgttctccctcctggagaatgggatccaagcattcgaatagagcctcccaaaaatgttccttcccaggagaagaggaagattcctgctgtaccaaatggaacagcagctcatggggaagcagagccccacggaggacatagtggacctgaactccagcgaactggaaggatttttgggggacttattttagatatcaaaagaaaagctccatacttctggagtgacttcagagatgctttcagcctgcagtgcttagcatcttttctatttctctactgcgcgtgtatgtctcctgtcatcacgtttggaggactgctgggagaagcaactgaagggcgtataagtgcaattgaatctctctttggagcatccatgaccgggatagcctattctctctttggtggacagcctcttaccatattaggcagtacaggaccagttttggtgtttgaaaagattttgtttaaattttgcaaagaatatgggctgtcatacctatctttaagagctagcattggactttggactgcaactctatgtatcatacttgtggccacagatgctagttcccttgtctgctacatcactcggtttactgaagaagcttttgcttccctgatttgcatcattttcatttatgaggccctggagaagttgtttgaactcagtgaagcatatccaatcaacatgcataatgatctggaactgctgacacaatactcgtgtaactgtgtggaaccgcataatcccagcaatggcacattgaaggaatggagggaatccaatatttctgcctctgacataatttgggagaacctaactgtgtcagaatgcaaatcattgcatggagagtatgttggacgggcctgtggccatgatcacccatatgttccagatgttctattttggtctgtgatcctgttcttttccacagttactctgtcagccaccctgaagcagttcaagactagcagatattttccaaccaaggttcgatccatagtgagtgactttgctgtctttcttacaattctgtgtatggttttaattgactatgccattgggatcccatctccaaaactacaagtaccaagtgttttcaagcccactagagatgatcgtggctggtttgttacgcctttaggtccaaacccatggtggacagtaatagctgctataattccagctctgctttgtactattctaattttcatggaccaacagattacagctgtcatcatcaacaggaaagagcataagctaaagaaaggttgtgggtaccatctggacctattaatggtggctgtcatgctcggtgtatgctccatcatgggcctgccatggtttgtggctgccacagtcctctccatcactcatgtcaatagcctaaaactggaatcagaatgctcagctccaggagaacaacccaaatttctcggcattcgggagcaaagggttactgggcttatgatttttattcttatgggttcatcagtctttatgaccagtattctgaagtttattcccatgccagtgctatatggagtgtttctttatatgggtgcttcatctctaaagggaattcagttctttgataggataaagctcttctggatgccggcaaaacatcaaccagattttatatacctaaggcacgtaccgcttcgaaaagtgcatctcttcacaattattcagatgagttgccttggccttttgtggataataaaagtttcaagagctgctattgtctctcccatgatggtgttatccctggtttttgtaagaaagttgatggacttgttgttcacgaaacgggaactctgctggttggatgatttgatgcctgagagtaagaaaaagaaactggaatatgctgaaaaagaagaagaacaatgtgtgctacctatggaagatgagggcacagtacaactcccattggaagggcactatagagatgatccatctgtgatcaatatatctgatgaaatgtcaaagactgccttgtggaggaaccttctgattactgccgataactcaaaagataaggagtcaagctttccttccaaaagctccccttcctaatcactctagaagctgattccccaaagcattgaaagccgaaaagagaagaaagctgactcagggatagttgttgacagggagacttgtctatgactcgatcttcaatttattttttacatatatatgagaagagtgtcacaattattaataaaactgcttggatcatgtatggtaaattctgtccctcaacccaaatccactttcatacggtaagtagggcaaaacttgtttcatttcggtgttaaaatttcggagcaggagacatccctgtgagcagaaacaatagccaatgcagaatctgtgtgttccttgctgaacgtaagacatttgtaaactggattctgattgtcagttttatgagagcaatagcttccttaaagagataagtcatatacacctagtttgtattctcatactttagagacctgaagacgcctgataatttcattcaggagaatttttgaaaggtagtcaaacttctttttagtttttatagcttagcattagtgacttatttcaaaagacccaaatcaaaaagttagtttgaaagcattttttaataattgtatttatgcattt

SEQ ID NO: 817 - DNA, 3658 bp, Homo sapiens
aaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgttttgggaagtgcatttgcttcgtggctccgccgagcctgctgaatcctgtcctcgcggcacgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtggcggccaagtgcccgcgcctctccgagtgctccagccccccggactacctcagcccccccggctcgccctgcagcccgcagcccccgcctgccgctccgggggccggcggaggctccgggagcgcgccggggcccagccgcatcgccgactacctgctgctgcccctagccgagcgcgagcatgtgtcccgggcgctgtgcatccacactggacgcgagctgcgctgcaaggtgtttcccattaaacactaccaggacaaaatcaggccttacatccagctgccatcgcacagcaacattactggcattgtggaagtgatccttggggaaaccaaggcctatgtcttctttgagaaggactttggggacatgcactcctatgtgcgaagccggaagaggctgcgggaagaggaagccgcccggctcttcaagcagattgtctccgccgtcgcccactgccaccagtcagccatcgtgctgggggacctgaagcttaggaagttcgtcttctccacggaggagagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatgggaaagttccttttttggcttaacactcaccctttcttcacactcacatttaccaatgactctgctccgtttttggagcagactgttttaagttgctcaggagcctgatggaaccatgaaccgagactcttctctgtttcctgccaagacctcatctgcactaatgccttctccctgaccttgacacttccccctttagctataaaagcacttaccagccgaacgtggaacagtatcacaaaagattccatctcccaacgatttcagaactctgagctcagagagactccagattttaaaaaataatttgagtgcttggaaactattagctttttaagttccttccaaatatgttagtacctaccctttactttttccccaagaccatctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagagaaattttaataaacctggtttcgtaaaaaaaaaaaaaaaaaaaaaaaaaaaa

SEQ ID NO: 818 - DNA, 927 bp, Homo sapiens
atggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgccggagctcaccttccgccagttccacgcgcgcctctgtggctacttcggcacccgtgcggggccccggctgccccgcggcgctctcagcgagcacatcgagacgcagatccgcctgcgccacttatggggctccctgtgggagaaacagagacaagtgagaaacagacaatgtggctcacactgtggatcaggcactcacgggccaccaagtgcctgcgggaaccagacccgctctgggctattgagaagaaaccatggggtcggactctggaagagccaggcgagcacccacgagatggggcacggcgggccggaggctgcggtgcgggagctgcgtcaggcgcagggcgccctggctgcggcggaggcccgcgctgggcggctgcgccgtggccaggccgaggtgcggcggcgcgcggaggaggcccggcaggtggtgctgcgcagcctgcaccgcgtgcgagagctggaggcgctggcgcaacaggtgcccggcttgcagcgctgggtgcggcggctggaggcggagctgcaacgctacaggtga

SEQ ID NO: 819 - DNA, 2774 bp, Homo sapiens
ccggcgcgggcgccatgaatctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcagaac

SEQ ID NO: 820 - DNA, 501 bp, Homo sapiens
atgaatgggtatcagggagattgtagctgctgcagccgtcagtgcacccagaaaccagaggaaggctccctgctgcgggagagcctggcagggattcctgccagagctgtcccctcccagcgggccagcctcaagccctccctcccgcatgctcggtcaagctctcctccgtgcagctgccaggggcagctgtctcatggccacgtgtggctctgccccctgacttggctgcccaaccccgtcgtctacctgatgaaggccttcgacctcctagtggaccgaccggcgaccctcgtgagagtttatagagtggcagcacgcaaagaacaggtagaactgggccaaggaagtggagcattcacccaggtggccaaggcttaccaggaccgctatcaggacctgggggcccaccattctgccaggaagtgccgggccaaacacaagcagaggatgctggaagagagaaaagctgcaaaagaggccaccgctgccgcctcctga

SEQ ID NO: 821 - DNA, 2712 bp, Homo sapiens
gttcggctgaggaagggagcgcacgccggcggcgcggaggccggctctgcgcttcgggccgccccctccccccaccccgctcacacccggcacttacttcggctgtctccgctgccctccagcggagacgcagctcctcaggcgcccggcggtatttgttgggtcggcggcgtcagggattcgcagtggcctgtggtcggcgtcgtccggccactggtgcgcccccgcggcaggcagagctcacgctcctgtcccccggctggtccggggtctgggcgccgcgtcgacggcggctccgcaggacgcgcagaccgggccgcagcccatgccccgagcggactgcattatgaggcacctgccttacttctgccggggtcaagtggtgcggggcttcggccgcggctccaagcagctgggcatccccacagctaattttcctgagcaagtggtagataatcttccagctgatatatccactggtatttactatggttgggccagtgttggaagtggagatgtccataagatggtggtgagcataggatggaacccatattacaagaatacgaagaagtctatggaaacacatatcatgcataccttcaaagaggacttctatggggaaatcctcaatgtggccattgttggctacctgagaccagaaaagaactttgattctttagagtcacttatttcagcaattcaaggtgatattgaagaagctaagaaacgactagagttaccagaacatttgaaaatcaaagaagacaatttcttccaggtttctaaaagcaaaataatgaatggccactgatgaaaaattgtattatttattcattcactgttttctagtgtttctgtgtttattactgttcagcatcatcttggttatatactgaaaatcaaacactttactacagttgtgaattagtttaaaccgtacaatgttgttatcatatcatgcttcaactattaaattaagcccatcatatcatagcactaaaaagattgagttaaaaataagatttaaaaaatatatattgattaaaatgtaccactagaaaggtattacatgtgtataagtatgggtaaaaaggcaagtcactagtttgagatgaaaactaaaattttcatggtaaaatgccagcatgtatgtacttgtgtagtgtgtacttctaaacagagaaggcttataaaagtaaatgcattaaggccaagtgcagtggctcacaccggtaatcccagcactttgggaggccgaggtgggaggattgcttgagctcatgagttcaagaccagcctgggcaacatagcgagactccatctctataaataaaaaaaaaggaaatgcattaaatagaaggttgatagtttatcataaacctgcggggaagaaactcagactttctatttttgatattttgtgcattaatacattacaaacatgaagatgtttgtaaagttttgttttagtcattttctttgcagtcacatcattgtaccaccttcattattgtatagagctgcttcaattctgagtcctctggacttcccctgcctatctgtttgttgttgttgttgaagacagtaaaataagtgttttcaaatctatatgtctcctttttgttggataatgtttcttctttttaatggtaaatattcttgttcttcaacatttttctttggttcttttttccttttttaggaaaaacaaaacaacagacttcatccttaggttttctcaagatttaagtgaacacatttacacatatcaatttcttaaagaacacaaaatgtttcctccctagcaaaactatttaagagccaattaaactatgaaatagttataaaattatttttaatatttaaggccttgaaattatattccaaggcaaatctaaatgggtgtagttgtatatgcacgatgtaatttaatgctaaagagtacttacagcttgagggaaaagcataaagttttagttaaatagccttcatactgtggatttttcctcctactaactaatatgtgggaaattaagattacagatgctttgggccccctcaaacagtacattgctacagttcactgtagcaacagatttggtggtgatggggggatagaggtagaagcagatagaaggtaattttaaagttaatttattatgaatcattttcccctaatctgcataaatgaattagaactgattttaataaaaatattctgtgtaaaaagtactcagaaaaacatctaaagctgttggagaagagggactcatataaatagttggattgcgttttgctttttatttctttataaaaatatgtcaaaaacagtttttaattttagaaatcttatacttgaaagaaacctcaattatcagtggctttatgaagtaaagttaaaaacaaacataggaaatgtgaaaatatttgtgtttgttttgtctgactaacttgctgctaaatgctatctttaggtgtgtgaaagttctttgatatgttattgtccttttacatcttgttaaatagccattgcttttgagaatcagatagtgtgttgtttaggggttaattgtgtctatatctttcaaaaacttttatattatgtattataagaagttacagtagtaccattttgattagtctgaatgttttcaggccttgaaataaattttgactaagtaaaaaaaaaaaaaaaaaaaaaaaaaaaaa

SEQ ID NO: 822 - DNA, 5945 bp, Homo sapiens
cggcggcggcggcaggagggggagcaggtgctggcacaagagcagcggcttgggggagccggcagcagcagtaacagcagcagcagccgccgccgccgccgccagtaaacgcggaccgtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaagggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagcttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatgagctctcattttttaagctgcctttgaaacaaaagagttgaggataggagatagaatggaattttaggggggttgcctaatttttttaagcctcaattcaaagattatatagcaaaagtgaaacttcttgtttgatattttcattcaaaactttcccaccctgaagagtcattgatcagatattagattatataagaagtctgttgccagggagccagtattcatgtatatttggcttgtgtgtttatttcgtgtattgagaatgaacacctttactttgcctcattcctagtaccctccctggagttcagatttttttttaaaattttgtatgtctcgtctgattcaatctctctgcttttattttatggtcctagttgtactatcaaatccaattacttttttttaggtccccctgattttttttttttagagcaagagttcttaacatattacatttttattatgaaaaataagaaagttaggtaaaggaaagaaaagtctaactagagctattttgcaggctttagtgtttagggagagaaagaaagtgtgggttaatagccttcaagatagaagatgccctttcatctctgttaagtgtcctcctttagaaacttgagtagaaggaaaactgaccagagtagactgcttccttaagtcttctgggttccaactgtttgtaatatcagcatccaagatgatacgagggaagcacaatgctttggactgtgatttgagatttagaaataaattagatatattattgaggcttagaatcctcaaactttgtattttatacatttagccaataaggaattaatatctggggaaataaatttaggcaaatatttcttttttaatgttttattacctgcttctcctgtgttttagttcaacatttgggcttcttggcctgattttcatacaatctcaatttacgaagctgtaaagaggaagatatttgttctaatctcactcttctaataggaatcaggcaaatgaaagtctaccagacttttaaaatgggctgtttttatactctctaggtgttttgtgttgtaaagaccttattaaggtcaggtaaattggtctgcttgctgttgaaatttgccttctagcaaacatatgtgctttctgtttgaccttgtgtttgctgccaaacctaatacagttgaattgggaaacaaaaaaaaaagaaaggaatacatttcctccccaagtgaacatcttctaatgctgcatcaaagctgccctgaagctgcactgaacttctcttgttctctttatctgtgttgagctttttaaaaaaacaaactcaaaacactattgaggcatataacgtctcttataagaaatgtagcatagtgtggaatcttaatttctctccagtttcaaacactccagaggaatgcaatagataagacatacttgctgtttatctaaagcaactgtaatattggaagatcagtccttctgtattatattgtataatagttgctataacactacttgcatgtcttcatggtaaattatataaatatttataaatatatagagagacatatccttatatagagtcatt

SEQ ID NO: 823 - DNA, 5613 bp, Homo sapiens
agcaggtgctggcacaagagcagcggcttgggggagccggcagcagcagtaacagcagcagcagccgccgccgccgccgccagtaaacgcggacggtaccccaggggactacccagccggccggccctggaagccgcgctcgggtcccgccgcagtcggcggtgggggatgggcaggcagtggcggtcccgcctgccgagggttaacccccgccggtcccggtcctgagctggaccagagccctcctccagaaacccctgcgtccgccacggcccaggttaaatggaaaccacccttgggaactggatgcctgtgtagctgttctaccatatcagtgtattgcaatgagtgggggaggagagcagctggatatcctgagtgttggaatcctagtgaaagaaagatggaaagtgttgagaaagattgggggtgggggctttggagaaatttacgatgccttggacatgctcaccagggaaaatgttgcactgaaggtggaatcagctcaacaaccaaaacaagttctgaaaatggaagttgctgttttgaaaaagctgcaaggaaagaccatgtttgtagatttattggctgtgggaggaatgatcgattcaactatgtggtcatgcagttgcagggtcggaatctggcagatcttcgccgtagccagtcccgaggcacattcaccattagtaccactctccggctgggtagacagattttggagtctattgaaagcattcattctgtgggattcttgcatcgagacatcaaaccgtcgaacttcgctatgggtcgctttcctagtacatgtaggaaatgttacatgcttgattttggcttggctcgacaatttaccaattcctgtggtgacgtcagaccacctcgagctgtggcaggttttcgagggacagttcgttatgcatcaatcaacgcacatcggaacagggaaatgggaagacatgatgacctttggtccttattctacatgttggtggagtttgtggttggtcagctgccctggagaaaaataaaggacaaggagcaagtaggctctattaaggagagatatgaccacaggctcatgttgaaacatctccctccagaattcagcatctttctagaccatatctcttctttggattattttacaaaaccagactaccagatgtccatcagggtgacccggaagtcctacaaggtgtccacctctggcccccaggcctttaacagcctctcctacacgagtgggcctggtgcctgcatcagctcctcgagcttctcccgaatgggcagcagcagcttccggggtggcctgggtgcaggatatggtggggccagtggaggcatcaccaccatcactgtcaaccaaagcctgctgagccctcttaacctggaggtggaccccaacatccaggccgtgcgcacccaggaggagaagcagatcaagaccctcaacaacaagtttttctccttcatagacaaggtacggttcctggagcagcagaacaagatgcttgagaccaagtggagcctcgtgcagcagcagaagatggctcggagcaacatggacaacatgttcgagagctacatcaacaaccttaagtggcagctggagactctgggccaggagaagctgaagctggaggcggagcttggcaacatgcatgggctggtggaggacttcaggaacaagtatgaggttgagatcagtaaatgtacagagatggagaatgaatttgtgctcatcaaggagtatgtagatgaagcttacatgaacaagatggagctggagtcttccctgaaagagctgactgccaagatcagcttcctcaggcagctgtatgaagaggagatcgggagctgcagtcccagatctcggatacatctgtggtgctgttcatggacaacagccgcttcctggacatggacagcatcatccctgaggtcaaggccagagggcttccctggaggctgccacgcagataccgagcagcgtggggagctagccattaaggatgccaatgccaagctgtctgagctggaggccgccctgcagctagccagtcaagacatggcgcggcagctgcgtgagtaccaggagctgatgaacgtcaagctggccctggatatcaagatcgccacctacaggaagctgttggagggcgaggagagctggctggagtctgggatgcagaacatgagtatccatatgaagaccaccagcagctatgcaggtggtcagagcttggcctatgggggcctcacaagccctggcctcagctacggcctgggctccagctttggctctggcatgggctccagctccttcagccacaccagctcctccagggccgtggtcatgaagaagatcgaaacccgtgatgggaagctagtgtctgagtcctccaacgtcctgcccaatttgagaattactgccacacttcttacatccgtgtttgacaatagcatcaagacttttggagtaattgagagtgacccttttgactgggagaagactggaaatgatggctccctaacaaccaccactacttctaccacccctcagttgcacactcgcttgacccctgctgcaattggaattgccaatgctactcccatccctggagacttgcttcgagaaaatacagatgaggtatttccagatgaacagcttagcgatggagaaaatggcatccctgttggtgtgtcaccagataaattgcctggatctctgggacacccccgtccccaggagaaggatgtttgggaagagatggatgccaacaaaaacaagataaagcttggaatttgtaaggctgctactgaagaggagaacagccatggccaggcaaatggtcttctcaatgctccaagccttgggtcaccaattcgtgtccgctcagagattactcagccagacagagatattccactggtgcgaaagttacgttccattcacagctttgagctggaaaaacgtctgaccctggagccaaagccagacactgacaagttccttgagacctgcctggagaaaatgcagaaagataccagtgcaggaaaagaatctattctccctgctctgctgcataagccttgcgttcctgctgtgtcccgtactgaccacatctggcactatgatgaagaatatcttccagatgcctccaagcctgcttctgccaacacccctgagcaggcagatggtggtggcagcaatggatttatagctgttaacctgagctcttgcaagcaagaaattgattccaaagaatgggtgattgtggacaaggagcaggaccttcaggattttaggacaaatgaggctgtaggacataaaacaactggaagtccttctgatgaggagcctgaagtacttcaagtcctggaggcatcacctcaagatgaaaagctccagttaggtccttgggcagaaaatgatcatttaaagaaggaaacctcaggtgtggtcttagcactttctgcagagggtcctcctactgctgcttcagaacaatatacagataggctggaactccagcctggagctgctagtcagtttattgcagcgacgcccacaagtctaatggaggcgcaggcagaaggaccccttacagcgattacaattcctagaccttctgtggcatctacacagtcaacttcaggaagctttcactgtggtcagcagccagagaagaaagatcttcagcccatggagcccactgtggaactttactctccaagggaaaacttctctggcttggttgtgacagagggtgaacctcctagtggaggaagcagaacagatttggggcttcagatagatcacattggtcatgacatgttacccaacattagagaaagtaacaaatctcaagacctgggaccaaaagaacttcctgatcataatagactggttgtgagagaatttgaaaatctccctggggaaactgaagagaaaagcatccttttagagtcagataatgaagatgagaagttaagtagagggcagcattgtattgagatctcctctctcccaggagatttggtaattgtggaaaaggatcactcagctactactgaacctcttgatgtgacaaaaacacagacttttagtgtggtgccaaatcaagacaaaaataatgagataatgaagcttctgacagttggaacttcagaaatttcttccagagacattgacccacatgttgaaggtcagataggccaagtggcagaaatgcaaaaaaataagatatctaaggatgatgacatcatgagtgaagacttgccaggtcatcaaggagacctctctacttttttgcaccaagagggcaagagagagaaaatcacccctagaaatggagaactatttcattgtgtttcagagaatgaacatggtgccccaacccggaaggatatggttaggtcatcctttgtaactagacacagccgaatccctgttttagcacaagagatagactcaactttggaatcatcctctccagtttctgcaaaagaaaagctcctccaaaagaaagcctatcagccagacctagtcaagcttctggtggaaaaaagacaattcaagtccttccttggcgacctctcaagtgcctctgataaattgctagaggagaaactagctactgttcctgctcccttttgtgaggaggaagtgctcactcccttttcaagactgacagtagattctcacctgagtaggtcagctgaagatagctttctgtcacccatcatctcccagtctagaaagagcaaaattccaaggccagtttcatgggtcaacacagatcaggtcaatagctcaacttcgtctcagttctttcctcggccaccaccaggaaagccacccacgaggcctggagtagaagccaggctacgcagatataaagtcctagggagtagtaactccgactcagaccttttctcccgcctggcccaaattcttcaaaatggatctcagaaaccccggagcactactcagtgcaagagtccaggatctcctcacaatccaaaaacaccacccaagagtccagttgtccctcgcaggagtcccagtgcctctcctcgaagctcatccttgcctcgcacgtctagttcctcaccatctagggctggacggccccaccatgaccagaggagttcgtccccacatctggggagaagcaagtcacctcccagccactcaggatcttcctcctccaggaggtcctgccaacaggagcattgcaaacccagcaagaatggcctgaaaggatccggcagcctccaccaccactcagccagcactaaaaccccccaagggaagagtaagccagccagtaaactcagcagataggagccaggctgcatctctttgaaaggtgtgagatcttcctcctaaacctgatgcatgtgtgtccctgtactttctatgtaaaaaaatcagtgttgatcttctcttgcaaaagaaagtaacatgatcaattatttataagaagacataatacatgataaggaattacctaaggcaggcagcaagtagattaggaatcaatgtctttgtacaagaaggaaaaatagagcaaaaatccaagggggagaaactcattaaaatga

SEQ ID NO: 824 - DNA, 2280 bp, Homo sapiens
tccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctctaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttaaaaaaaaaaaaaaaaaaaaaaaaaaaaaaaataaaaaaaaaaaaaaaaaaaaaaaaaa

SEQ ID NO: 825 - DNA, 1964 bp, Homo sapiens
atagcaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaatcgagagagttgcaagagtgagaggaggggaaggaactggttacttcgtggacttctctgtgcggaactgccccagacaccatttccccagacaccccaatgtctttggattctgcagagcagatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacattctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccccgtcccttccattgcagacaaattggatctgtgtaccgactccctcctctaagaaaaggtgaggtgctgccacttcctgaggccaattttcccagcttcccattgccgcaccacaaacatcctctaaagccagacaatcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactaaaaaaaaaaaaa

SEQ ID NO: 826 - DNA, 2892 bp, Homo sapiens
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaaaaaaaa

SEQ ID NO: 827 - DNA, 2912 bp, Homo sapiens
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctaggtgagagctgccaagtccagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaaaaaaaa

SEQ ID NO: 828 - DNA, 3416 bp, Homo sapiens
gctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaa

SEQ ID NO: 829 - DNA, 3641 bp, Homo sapiens
gctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaa

SEQ ID NO: 830 - DNA, 3584 bp, Homo sapiens
gctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaaaaaaaaaaaaaaa

SEQ ID NO: 831 - DNA, 1807 bp, Homo sapiens
ggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtgcgttatccagaacgcattacaatattgagaggaaatcacgaaagccgacaaattacccaagtatatggcttttatgatgaatgtctgcgaaagtatgggaatgccaacgtttggaaatattttacagatctctttgattatcttccacttacagctttagtagatggacagatattctgcctccatggtggcctctctccatccatagacacactggatcatataagagccctggatcgtttacaggaagttccacatgagggcccaatgtgtgatctgttatggtcagatccagatgatcgtggtggatggggtatttcaccacgtggtgctggctacacatttggacaagacatttctgaaacctttaaccatgccaatggtctcacactggtttctcgtgcccaccagcttgtaatggagggatacaattggtgtcatgatcggaatgtggttaccattttcagtgcacccaattactgttatcgttgtgggaaccaggctgctatcatggaattagatgacactttaaaatattccttccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattcaaaaaaaaaaaaaaaaaa

SEQ ID NO: 832 - DNA, 7410 bp, Homo sapiens
atgggcagccaggccctgcaggagtggggacagagggaacccggccggtggcccgaccctgcagggaagaaggacgtgcggcgagaagcatcggattcggggagggccgggacctggccgaggacagccaaggaaaaactaaagatcgacggggacacccgcctcccttcctcgccccaacggtttctcagaggctgtggggacttgcaccagaaacccaagttggaactaattctttctttcggaaggtgcaactcccctcccgcgagctccgcggtgccgggccgagattgccgagaggaagcggcgcagcgctgccgccaaggctcctcctgtcgccggtgcggccgggactacctggcggcgcggcgcgggccgagcgaatgtagcccgcgagagaaaatggcggcggcggcggggaatcgcgcctcgtcgtcgggattcccgggcgccagggctacgagccctgaggcaggcggcggcggaggagccctcaaggcgagcagcgcgcccgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcgagccgcggcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacgtctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctagacctaccccaggtaatacaagtaaacagggagatccctcaaaaaatagcatgacacttgatctgaacagtagttccaaatgtgatgacagctttggctgtagcagcaatagtagtaatgctgttatacccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggatgccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggcctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatgcagatcaactacagtagaaacaggatgctcaacaagagaaaaaaaacttgtggggaaccacattgatattctactggccatgatgccactgaacagctatgaacgaggccagtggggaacccttacctaagtatgtgattgacaaatcatgatctgtacctaagctcagtatgcaaaagcccaaactagtgcagaaactgtaaactgtgcctttcaaagaactggccctaggtgaacaggaaaacaatgaagtttgcatgactaaattgcagaagcataattttatttttttggagcactttttcagcaatattagcggctgaggggctcaggatctattttaatatttcaattattcttccatttcatatagtgatcacaagcagggggttctgcaattccgttcaaattttttgtcactggctataaaatcagtatctgcctcttttaggtcagagtatgctatgagtagcaatacatacatatatttttaaaagttgatacttctttatgacccacagttgacctttattttcttaaataccagggcagttgtggctcattgtgcattttactgttggcccattcatttcgtttttggaaattatggttttgtattttcatgtttatttacattcatttttgtttattcagggaaagctgatctttttttcaaaccagaaaaaaaaaatgaactagatatgaagtagagttcattaaatatcttgctattgtcagagtttttaaaatatagacttaattttgtttttttaaattggaatacaataaagtactacctacatttgagtcagtcaccactcttattgtgcaggttaagtacaagttaactaaaaataaactgtcctctctggtgcaactcacaaccaagatcaagattaccttaaaatttatttgaattttttagatgttttggttgtcaaactgtaggaaacttcacaacatttaagtcttactctgtatgtaacaatccatcattcaccttcactactggtagtaacatagagctgccattttccttttaccatgcatcatctctttacagtaggcctggcagatcattttttaaaaagattattcaactaccaatcagtaatgtttttaaacagtacatttgctttgaacttggaaaatgtgttcagaaagaaaaatggaattgaatttcatttatacactaattccttggattttgcacagttacctaacggttttagtctggagttaaattcagatgcatggaatcctgaaggaaaatggtagctttttaatctttttgtgtgtgtgtgagtcttttaaatcaagtactgattaactattaagtacaactttgagattttagttttaactcttcagaagccagtgtgaaatagaattggttattctcaaagactcaggataaactaaataagctatatatagagtacatttaaaatgtacaacacaaattggaaataaaataagttacaagataagtttacagggatatattgcttacaatttttaaaaggcagtttgttttttatgtgaatatgtttcttagtgaaattttacattcctttgttttggaagattggcgatatttgaagagttaaaaatagtacagaaatgtgaagtttggtatctctaaatgtgttgtacttgactttcttttttattttgtttttttttttttttgactacttagaattttcacaattctaataagattgtttccaagtctctcatgtgcaagctttaaaggatgcactcttgccattttatgtactggaagatcattggtcagatgaatactgtgtctgacaaaaatgtaaactgtataaactgaggaacctcagctaatcagtattactttgtagatcaccatgcccaccacatttcaaactcaaactatctgtagatttcaaaatccattgtgtttgagtttgtttgcagttccctcagcttgctggtaattgtggtgttttgttttttgttttgttttcaatgcaaatgtgatgtaatattcttattttctttggatcaaagctggactggaaattgtatcgtgtaattatttttgtgttcttaatgttatttggtactcaagttgtaaataacgtctactactgtttattccagtttctactacctcaggtgtcctatagatttttcttctaccaaagttcactttcacaatgaaattatatttgctgtgtgactatgattcctaagatttccagggcttaagggctaacttctattagcaccttactgtgtaagcaaatgttacaaaaaaaaaaaaaaaaaatctctgggttaagaaaatttggcttaaatgtatcctttgttattttaaatatattgagatattttaattaaaatttttaccccattgaaccgattttatagtatttgtacctattttggtgtttttgtctttatagtaaataaaagtttttgaac

SEQ ID NO: 833 - DNA, 4470 bp, Homo sapiens
aattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacctaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacac

SEQ ID NO: 834 - DNA, 4166 bp, Homo sapiens
caggtggaatgtcagaagactgagaacattgttccttcttcatactgctgctctgttgccagagaatcccaatttacactcaaagcttctttgattaagtgctaggagataaatttgcattttctcaaggaaaaggctaaaagtggtagcaggtggcatttaccgtcatggagagcagggatcataacaacccccaggagggacccacgtcctccagcggtagaagggctgcagtggaagacaatcacttgctgattaaagctgttcaaaacgaagatgttgacctggtccagcaattgctggaaggtggagccaatgttaatttccaggaagaggaagggggctggacacctctgcataacgcagtacaaatgagcagggaggacattgtggaacttctgcttcgtcatggtgctgaccctgttctgaggaagaagaatggggccacgccttttatcctcgcagcgattgcggggagcgtgaagctgctgaaacttttcctttctaaaggagcagatgtcaatgagtgtgatttttatggcttcacagccttcatggaagccgctgtgtatggtaaggtcaaagccctaaaattcctttataagagaggagcaaatgtgaatttgaggcgaaagacaaaggaggatcaagagcggctgaggaaaggaggggccacagctctcatggacgctgctgaaaaaggacacgtagaggtcttgaagattctccttgatgagatgggggcagatgtaaacgcctgtgacaatatgggcagaaatgccttgatccatgctctcctgagctctgacgatagtgatgtggaggctattacgcatctgctgctggaccatggggctgatgtcaatgtgaggggagaaagagggaagactcccctgatcctggcagtggagaagaagcacttgggtttggtgcagaggcttctggagcaagagcacatagagattaatgacacagacagtgatggcaaaacagcactgctgcttgctgttgaactcaaactgaagaaaatcgccgagttgctgtgcaaacgtggagccagtacagattgtggggatcttgttatgacagcgaggcggaattatgaccattcccttgtgaaggttcttctctctcatggagccaaagaagattttcaccctcctgctgaagactggaagcctcagagctcacactggggggcagccctgaaggatctccacagaatataccgccctatgattggcaaactcaagttctttattgatgaaaaatacaaaattgctgatacttcagaaggaggcatctacctggggttctatgagaagcaagaagtagctgtgaagacgttctgtgagggcagcccacgtgcacagcgggaagtctcttgtctgcaaagcagccgagagaacagtcacttggtgacattctatgggagtgagagccacaggggccacttgtttgtgtgtgtcaccctctgtgagcagactctggaagcgtgtttggatgtgcacagaggggaagatgtggaaaatgaggaagatgaatttgcccgaaatgtcctgtcatctatatttaaggctgttcaagaactacacttgtcctgtggatacacccaccaggatctgcaaccacaaaacatcttaatagattctaagaaagctgctcacctggcagattttgataagagcatcaagtgggctggagatccacaggaagtcaagagagatctagaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagagccgctataggacgcttcggaatgtgggaaatgaatccgacatcaaaacacgaaaatctgaaagtgagatcctcagactactgcaacctgggccttctgaacattccaaaagttttgacaagtggacgactaagattaatgaatgtgttatgaaaaaaatgaataagttttatgaaaaaagaggcaatttctaccagaacactgtgggtgatctgctaaagttcatccggaatttgggagaacacattgatgaagaaaagcataaaaagatgaaattaaaaattggagacccttccctgtattttcagaagacatttccagatctggtgatctatgtctacacaaaactacagaacacagaatatagaaagcatttcccccaaacccacagtccaaacaagcctcagtgtgatggagctggtggggccagtgggttggccagccctgggtgctgatggactgatttgctggagttcagggaactacttattagctgtagagtccttggcaaatcacaacattctgggccttttaactcaccaggttgcttgtgagggatgagttgcatagctgatatgtcagtccctggcatcgtgtattccatatgtctataacaaaagcaatatatacccagactacactagtccataagctttacccactaactgggaggacattctgctaagattccttttgtcaattgcaccaaaagaatgagtgccttgacccctaatgctgcatatgttacaattctctcacttaattttcccaatgatcttgcaaaacagggattatcatccccatttaagaactgaggaacctgagactcagagagtgtgagctactggcccaagattattcaatttatacctagcactttataaatttatgtggtgttattggtacctctcatttgggcaccttaaaacttaactatccttccagggctcttccagatgaggcccaaaacatatataggggttccaggaatctcattcattcattcagtatttattgagcatctagtataagtctgggcactggatgcatgaattccactccttccagaaccaactgcattggttttccatgaccttaaggcagtagttctcaactggggggcaattttgcactgaagagagcatttggcagagtctgaagaagtttttggtgtcacagctttgtggggagcatgctatggcatttagtgggtaaagaccagggatgctgccaaacctgccttgcacaggacagcccctgcaacaaagaattatccagacaaaaatatcaatggtgctgaggttgagaaaacctgacttaaggggctgggatgcttttgaactagcttaaggcccaggactgtggagtgtgtggaccaccccacagaggagggactcagatttatttactcttgctggatctgtagtgatggagttccttctggtgtcagccccacaggaggctcccaggcctccctcacttcccatacccagtctaggagctccttctggctcccaagcacccagagctttcctccgccttttagttttggttcctccactggaatgtaggctcctcacgggcgatggctgtcttttcttgactttgtatcttcactgccaagcaaaaagtctgccaagtgggaatgtttaataaatattcattgaataatgaatgaaccatcttcgtacatgaataataatactgtcttacgtttttctggtgctttataatgtatacattacatctgagtattttattttatttaattttcaaaacaatcctttaaggtcaacattgttatccctattttgctgatgaggaaactaaggttagaaacattttgatttcctctaggacgtatagctaggaagtgttactatcttgatttgaacaaattttctggtgctaagtctgatgttctttccatgaatcattgtggtggttgagatggagctttgtaatgggaataaaacagtaccttaggttctttctgaaaaggaggtatctagcaatggataaatagataccactgaatgaaattaaatgttgattaggaacaaatttaaggcttaaaaaatactttatgagcagcaagattgctttaacttttaaaatgaagctttggttctctgatttgtaatgagcacctggacatgtcaattaaaatgcccatttgtgaagcttactcaataaaactttaaattgtcaaaaaaaaaaaaaaaaaa

SEQ ID NO: 835 - DNA, 2435 bp, Homo sapiens
gcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagattggagaacatcaattaacaggccataaagtggcagttaaaatcttaaatagacagaagattcgcagtttagatgttgttggaaaaataaaacgagaaattcaaaatctaaaactctttcgtcatcctcatattatcaaactataccaggtgatcagcactccaacagatttttttatggtaatggaatatgtgtctggaggtgaattatttgactacatctgtaagcatggacgggttgaagagatggaagccaggcggctctttcagcagattctgtctgctgtggattactgtcataggcatatggttgttcatcgagacctgaaaccagagaatgtcctgttggatgcacacatgaatgccaagatagccgatttcggattatctaatatgatgtcagatggtgaatttctgagaactagttgcggatctccaaattatgcagcacctgaagtcatctcaggcagattgtatgcaggtcctgaagttgatatctggagctgtggtgttatcttgtatgctcttctttgtggcaccctcccatttgatgatgagcatgtacctacgttatttaagaagatccgagggggtgtcttttatatcccagaatatctcaatcgttctgtcgccactctcctgatgcatatgctgcaggttgacccactgaaacgagcaactatcaaagacataagagagcatgaatggtttaaacaagatttgcccagttacttatttcctgaagacccttcctatgatgctaacgtcattgatgatgaggctgtgaaagaagtgtgtgaaaaatttgaatgtacagaatcagaagtaatgaacagtttatatagtggtgaccctcaagaccagcttgcagtggcttatcatcttatcattgacaatcggagaataatgaaccaagccagtgagttctacctcgcctctagtcctccatctggttcttttatggatgatagtgccatgcatattcccccaggcctgaaacctcatccagaaaggatgccacctcttatagcagacagccccaaagcaagatgtccattggatgcactgaatacgactaagcccaaatctttagctgtgaaaaaagccaagtggcatcttggaatccgaagtcagagcaaaccgtatgacattatggctgaagtttaccgagctatgaagcagctggattttgaatggaaggtagtgaatgcataccatcttcgtgtaagaagaaaaaatccagtgactggcaattacgtgaaaatgagcttacaactttacctggttgataacaggagctatcttttggactttaaaagcattgatgatgaagtagtggagcagagatctggttcctcaacacctcagcgttcctgttctgctgctggcttacacagaccaagatcaagttttgattccacaactgcagagagccattcactttctggctctctcactggctctttgaccggaagcacattgtcttcagtttcacctcgcctgggcagtcacaccatggatttttttgaaatgtgtgccagtctgattactactttagcccgttgatctgtctctagtttctttctgttattgcactatgaaaatcagttatattctttaaatttttatcttacttttggataatatccactgcaatactaattgagaaacatgaattatttccaggggcacacaatgctattgaaattactgaaaacaaaatatctgacatcttatttacttgtagaaatctgtaattctattgtgcctatgataaattcacataggcaatatctttaataggttaatatcaatgaagatttttaattacaataatgagttcactacagacgattaacacaccacactggcgaaccatctcaatgtaagggtggtttggcaacacctccttgctttgctgtttggtgtaggtaaatctagtttacttcctaaatttcagtaggctttatgctgtgtttatgcccccaatttattttaacaaaagaagattaaaaagtaaaagaaccacgagtaagatattatttaaatgttgaaatcttaaaaacctgcctccaagatttcagaagccaagtttttctaacagtatttgtacaaatactgcctagtgtattcaacagaaggactgtggtcatgtaacaggtaaccacaattttcaggtttcttaaaaacagctgtaactaactcaggatttttatcttgagatttccctgaataatatatttatcttaagagccttcaagtttcaaattaatattggaacatctggaattgcaacaactt

SEQ ID NO: 836 - DNA, 3133 bp, Homo sapiens
ccgctgaggccgcggcgcccgccagcctgtcccgcgccatggccccgcgcgcccggcggcgccgcccgctgttcgcgctgctgctgctctgcgcgctgctcgcccggctgcaggtggctttgcagatcgctcctccatgtaccagtgagaagcattatgagcatctgggacggtgctgtaacaaatgtgaaccaggaaagtacatgtcttctaaatgcactactacctctgacagtgtatgtctgccctgtggcccggatgaatacttggatagctggaatgaagaagataaatgcttgctgcataaagtttgtgatacaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgttgcagctcaacaaggacacagtgtgcaaaccttgccttgcaggctacttctctgatgccttttcctccacggacaaatgcagaccctggaccaactgtaccttccttggaaagagagtagaacatcatgggacagagaaatccgatgcggtttgcagttcttctctgccagctagaaaaccaccaaatgaaccccatgtttacttgcccggtttaataattctgcttctcttcgcgtctgtggccctggtggctgccatcatctttggcgtttgctataggaaaaaagggaaagcactcacagctaatttgtggcactggatcaatgaggcttgtggccgcctaagtggagataaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacatgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgtattccttttcataacttttcttgatatctttcctccctcttttttaatgtaaaggttttctcaaaaattctcctaaaggtgagggtctctttcttttctcttttccttttttttttctttttttggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaaaaaaaaa

SEQ ID NO: 837 - DNA, 2317 bp, Homo sapiens
aaaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctacacctcccagtccaggccccccgtccaggaccagctcagccagtcagagagatatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtcttacgtggcactcgcggttggagtcagcgaggagagcgaggcctggatcctggcagtggccaccggcctgttccttacgtagcactctgcgacatgctcccggcgatgttgaaagtacgggacccgcggcccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaacccagaagcccctatagaggccccagtcccaactccagtaaagacactcttgtcccttggaaaaaaaaaaaaaaaaaaa

SEQ ID NO: 838 - DNA, 2192 bp, Homo sapiens
agtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggaaaaaaaaaaaaaaaaaaaaaaaaa

SEQ ID NO: 839 - DNA, 2858 bp, Homo sapiens
gcgtcacttccgtccagaccggaacccaagatggctgcgctgttgctgagacacgttggtcgtcattgcctccgagcccactttagccctcagctctgtatcagaaatgctgttcctttgggaaccacggccaaagaagagatggagcggttctggaataagaatataggttcaaaccgtcctctgtctccccacattactatctacagttggtctcttcccatggcgatgtccatctgccaccgtggcactggtattgctttgagtgcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttgatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctacacagtgttattgaaagaagagaggtgggggtggaggggaattagtctgtcccagctagagggagataaagagggctagttagttcttggagcagctgcttttgaggagaaaatatatagctttggacacgaggaagatctagaaaattatcattgaacatattaatggttatttctttttcttggatttccagaaaagcctcttaattttatgctttctcatcgaagtaatgtaccctttttttctgaaactgaattaaatactcattttatctttgactctccttgaaatctagagaaaccaagaaaatggctgttgggaaggaaccaatttcctcctcttccctcgggtctcaggcatttacatcctccctctccccgcaatctgacctttaccaggagggaaacagttctcctacatctcatcattggaaaagttttcagggaatcagatagaacttagccagagatttaaatatcacagaaaagcctcagagaaggaaggagaaaaagaaaagaagtgacgcatgtagagtgcttttgggttataggcaccaaaatcccattaaggactgattataagcttcatggtacagttcagcaaattatgattcattgaggggcacagaggaccagtgttggtgacagctaggggatgatgacctgaggttataggcttggggtgaatgaagcatagagtttttttttaaaaaagaagggattgttgaaaacctggcaaaaatgtataatttaatgagaaaacttgctgcttttaaaatccatataggccaggctttagcaggcatgctgttttgatagtttttgggaactctggaataagagacttatctcatctgtcacttcgagttgttggccagccagttaaagctgtgggtcgaagaggggaaatgttaactggctggtgtcaattggataggaagaccttagttaaggtggggacccgctgttttaacagtcttcattcagggtcccaaatagtatttggctttaagtaatgattggttttccctttttactagaggggccctgggaagtccttgtacctttcctccattttaaaccagctgttctctactttgtccttggaatgagggacaagtgatcatgacagaacactttgtcattgggactgggaaaggtttggcaagggcattaaatttaacagccagtgccaggaaaatataaaatggggtcaatgataaacagctgttagaggctggaaaatgggtagggcagttgaattttttggtggtttcgtaccatttgggtgattgaagcatggtagtgggtgggtggggggtgtgacagagcatcatgtttgttattctgccttaaatttctacttactgtctttttcttctctgtcttccaatcactttaatatcttcaattttcaaactatatttgtacttgggcttagatagaaagtcttacacaagcatagtatcttctactttggttttccctaccttttcttccccaccttctccaaacacacatatacatactctactcaattctatttctgattttgtagttgttagttgtccatgctcaggataaaaaatgagtgggtagggttgagggactggttctttgaggttctgccctttttccatgattcagaccaactttctcttggtcatttctggagtataactgactcaattcttgtaaaaatgtgttccacccaaaccactgtatgttcttttccctactttattttctcctaccttccttctcctaattgtgttacaagaggcagccatagcaagaatggaaaatccagatcagtaaaagattcaacaaaaaaaa

SEQ ID NO: 840 - DNA, 1579 bp, Homo sapiens
gaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactctttccagacttcatctgagactccttcttcagccaacattccttagccctgaatacatttcctatcctcatctttcccttcttttttttcctttcttttacatgtttaaatttaaaccattcttcgtgaccccttttcttgggagattcatggcaagaacgagaagaatgatggtgcttgttaggggatgtcctgtctctctgaactttggggtcctatgcattaaataattttcctgacgagctcaagtgctccctctggtctacaatccctggcggctggccttcatcccttgggcaagcattgcatacagctcatggccctccctctaccataccctccacccccgttcgcctaagctcccttctccgggaatttcatcatttcctagaacagccagaacatttgtggtctatttctctgttagtgtttaaccaaccatctgttctaaaagaagggctgaactgatggaaggaatgctgttagcctgagactcaggaagacaacttctgcagggtcactccctggcttctggaggaaagagaaggagggcagtgctccagtggtacagaagtgagacataatggaatcaggcttcacctccaaggacacctatctaagccattttaaccctcgggattacctagaaaaatattacaagtttggttctaggcactctgcagaaagccagattcttaagcaccttctgaaaaatcttttcaagatattctgcctagacggtgtgaagggagacctgctgattgacatcggctctggccccactatctatcagctcctctctgcttgtgaatcctttaaggagatcgtcgtcactgactactcagaccagaacctgcaggagctggagaagtggctgaagaaagagccagaggcctttgactggtccccagtggtgacctatgtgtgtgatcttgaagggaacagagtcaagggtccagagaaggaggagaagttgagacaggcggtcaagcaggtgctgaagtgtgatgtgactcagagccagccactgggggccgtccccttacccccggctgactgcgtgctcagcacactgtgtctggatgccgcctgcccagacctccccacctactgcagggcgctcaggaacctcggcagcctactgaagccagggggcttcctggtgatcatggatgcgctcaagagcagctactacatgattggtgagcagaagttctccagcctccccctgggccgggaggcagtagaggctgctgtgaaagaggctggctacacaatcgaatggtttgaggtgatctcgcaaagttattcttccaccatggccaacaacgaaggacttttctccctggtggcgaggaagctgagcagacccctgtgatgcctgtgacctcaattaaagcaattcctttgacctgtca

SEQ ID NO: 841 - DNA, 1944 bp, Homo sapiens
gcagagcgggcggcggcggcggcggcagcggaggcggcggctccagccggcgcggcgcgaggctcggcggtgggatccggcgggcggtgctagctccgcgctccctgcctcgctcgctgccgggggcggtcggaaggcgcggcgcgaagcccgggtggcccgagggcgcgatggctgctcctgtcccgtgggcctgctgtgctgtgcttgccgccgccgccgcagttgtctacgcccagagacacagtccacaggaggcaccccatgtgcagtacgagcgcctgggctctgacgtgacactgccatgtgggacagcaaactgggatgctgcggtgacgtggcgggtaaatgggacagacctggcccctgacctgctcaacggctctcagctggtgctccatggcctggaactgggccacagtggcctctacgcctgcttccaccgtgactcctggcacctgcgccaccaagtcctgctgcatgtgggcttgccgccgcgggagcctgtgctcagctgccgctccaacacttaccccaagggcttctactgcagctggcatctgcccacccccacctacattcccaacaccttcaatgtgactgtgctgcatggctccaaaattatggtctgtgagaaggacccagccctcaagaaccgctgccacattcgctacatgcacctgttctccaccatcaagtacaaggtctccataagtgtcagcaatgccctgggccacaatgccacagctatcacctttgacgagttcaccattgtgaagcctgatcctccagaaaatgtggtagcccggccagtgcccagcaaccctcgccggctggaggtgacgtggcagaccccctcgacctggcctgaccctgagtcttttcctctcaagttctttctgcgctaccgacccctcatcctggaccagtggcagcatgtggagctgtccgacggcacagcacacaccatcacagatgcctacgccgggaaggagtacattatccaggtggcagccaaggacaatgagattgggacatggagtgactggagcgtagccgcccacgctacgccctggactgaggaaccgcgacacctcaccacggaggcccaggctgcggagaccacgaccagcaccaccagctccctggcacccccacctaccacgaagatctgtgaccctggggagctgggcagcggcgggggaccctcggcacccttcttggtcagcgtccccatcactctggccctggctgccgctgccgccactgccagcagtctcttgatctgagcccggcaccccatgaggacatgcagagcacctgcagaggagcaggaggccggagctgagcctgcagaccccggtttctattttgcacacgggcaggaggaccttttgcattctcttcagacacaatttgtggagaccccggcgggcccgggcctgccgccccccagccctgccgcaccaagctggccctccttcctccctcaggggaggtgggccatgcagctaacccacccaccaaagaccccctcaccctggccccttgggctggaccctccaatgccagcgactcccaggagcccttgggggacgtgaggggagcctctcacatccgatttctcctcctgccccagcctcctgtctatcccagggtctctgttgccaccatcagattataagctcctgatgctgggggggcccagccatccccctccccccagcacccacaattttcagtcccctcccctctgccctgttttgtatacccctcccctgaccctgctcctatcccacagtatttaatgccctgtcagtcccttctagtctgactcaatggtaacttgctgtatttgaattttttatagatgtatatacagggtggggggagtgggcggttctcattaaacgtcaccatttcatgaaaaaaaaaaaaaaaaaa

SEQ ID NO: 842 - DNA, 6316 bp, Homo sapiens
tagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaaacgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagttaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 843 - DNA, 4848 bp, Homo sapiens
gccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacggtcgccgcgtccaagtcggtgactgcccacttggccgcgaagtggcccgagaccccgctgctgctggaggcaagtgaatttatggcagaagaaagtaatgaaaaattttggcagtttttggaaactgtgcaagaattagcaatttataagcaaacagaatcagattattcttattacaacttaatcctgaagaaagctggacagtttctagacaatttacacatcaaccttttaaagtttgctttctctataagggcatactccccagctattcagatgtttcagcagattgcagctgatgagccaccaccagatggttgtaatgcatttgtggttattcataagaagcacacctgtaaaattaatgagattaaaaagctgctgaagaaagctgcttcaaggactagaccttatctatttaaaggagatcacaaatttcctacaaacaaagagaacttaccagtggtgattctctatgccgaaatgggtactagaacatttagtgcatttcacaaagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccactccagtttatgatgccattaaattaatgaaagacatttcacagaacttccccataaaagccagatctctaaccagaattgctgtaaatcaacatatgagagaagaaataaaggaaaatcaaaaggatcttcaagttagatttaaaattcagccaggcgatgctcgtctatttataaatggccttcgtgttgatatggatgtttatgacgcttttagtattttggatatgctgaaattagaaggaaaaatgatgaatggccttcgcaatcttgggatcaatggggaagatatgagcaaatttttaaaattaaattcacacatttgggaatatacttatgtattagatattcgacattcttctataatgtggattaatgacttagaaaatgatgatttgtatattacatggcctacaagttgccagaaacttctgaagccagtatttcctggaagtgtaccttccataaggcgcaattttcataatttggttctgtttattgatccggcccaagaatataccttggattttataaaacttgctgatgttttctattctcacgaagttcctcttagaattggttttgtgttcattcttaatacagatgatgaagttgatggagcaaatgatgctggagttgctctctggcgagctttcaactatattgcagaagaatttgatatatcagaagcatttatttctatagtacacatgtaccaaaaagtgaagaaggatcaaaatatactcactgtggacaatgtgaagagtgttctccaaaatacatttcctcatgctaatatttgggatattttgggaattcattctaaatatgatgaagaaagaaaggctggagcaagcttttataagatgactggcctgggtcctttgcctcaagctctttataatggtgaaccctttaaacatgaagagatgaatattaaagaactaaaaatggctgttcttcaaagaatgatggatgcatctgtatatttacaaagagaagtttttttgggcacattaaatgatcgcacgaatgcaattgattttctaatggataggaataatgttgtaccccgtataaatactttgattttgcgtactaaccagcagtacctcaatttaatatctacatcagtaactgctgatgttgaagatttctctactttctttttcttggattcacaagataagagtgctgtaattgcaaagaacatgtattatttaacccaagacgatgagagtataatttctgcagtcactctctggattattgcagattttgataagccttctgggagaaaacttctttttaatgcattaaagcacatgaaaacaagtgttcatagtcggttggggattatttataatcctacatcaaaaataaatgaagagaacacagctatttctagagggattttggcagcttttcttacacagaagaacatgtttttgagaagctttcttgggcaactggcaaaggaagaaattgctacaactatttactctggagataaaattaaaacattccttattgaggggatggataagaatgcttttgagaaaaaatataatactgttggagtgaatatttttcgaactcaccagttgttctgtcaagatgtacttaaattacgtcctggagaaatgggtattgtcagcaatgggagattcttaggacctttagatgaagatttttatgcagaagatttttacttgttggaaaagataacatttagtaatttaggagagaaaattaaaggcattgttgaaaatatgggaatcaacgcaaataacatgagtgactttattatgaaagttgatgcccttatgtcctctgtgcctaagcgtgcatctcgatatgatgtcacatttcttagggagaatcacagtgttataaagacgaatcctcaagagaatgatatgttcttcaatgtcattgctattgttgatccattaacaagagaagcacagaaaatggcacagttgttggttgtacttggcaagattatcaacctgaagataaagttgttcatgaactgtaggggcaggctttcagaagcccctttagaaagcttttaccgttttgttctggaaccagaactgatgtcaggggctaatgacgtttcttctcttggaccagtggcaaaatttttggatattcctgaatcacccctcctaatcctcaacatgattactccagaaggctggttggttgaaacagtgcacagcaactgtgaccttgataatattcacttaaaggatactgagaaaactgttacagcagaatatgaactagaatacttactactggaaggacaatgctttgataaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttttaagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacaaaatcatttttgttgatgctgaccagattgtgagacatgatctaaaagaacttcgagatttcgatctggatggagctccttatgggtatactccattttgtgatagccgcagggaaatggatggatatcgtttctggaaaacaggatactgggcatcacatcttttaagacggaaataccatatcagtgctttatatgtagtggatctcaagaagttcaggagaattggagcaggtgacaggctcaggagccagtatcaagctctcagtcaagatccaaacagtctttcaaacctagatcaggatctccccaataatatgatttaccaagtcgccattaagtctcttcctcaagactggctgtggtgtgaaacctggtgtgatgatgaatccaaacaaagagccaaaacaattgatctgtgcaataatcccaaaacaaaagaatccaaactaaaagctgctgccagaattgtcccagaatgggtggagtatgatgctgagataagacaactattagatcatcttgaaaacaagaagcaagatacaattttgacacatgatgaactctagcactggtgtatatgagaaggaaggcgaaagcatgacaggaaacctgccgcctgctggggaagtctggagcccctgctgagacgatttggaagtctcgttaagatcagtgacatattctttaattttaaaaaattgtaattatttaaaacagttatttaatgtattgaatgagtttaagttatataataaatgaccattgagtatttaaaaaaaaaaaaaaaaaaaa

SEQ ID NO: 844 - DNA, 393 bp, Homo sapiens
atgcctataattaaccttctcctacttatcattccaactctaatcgctatagcattccttacaatcattgaacgaaaaatcttaggctatatacacctacgcaaaggacctaacattgtaggtgcctgcggactgcttcaaccattcgctgacgcaataaaacgtttcatccaagagcccttacagacctcaacatctacatctactatcaccctttatattattgctccaaccctggccctttctatcactcttctctgtgaacatacccccaattctgctatgaccaactcatatcttctacgaaaaaatttcctatcacttacactagcattttgcatgtcatatatctcaatgcccgtcctaatttccagcattccacaccaaacatag

SEQ ID NO: 845 - DNA, 1520 bp, Homo sapiens
ggggatatcacctgagagagttcccaagtctacaattgctctactagttactattcagtgtttgtgaaaaattttaatctcagtactgtgaagaagctggaaaaagggatattatggggctaaaagctctctgtttggggctgctttgtgttctttttgtctctcatttttacacacccatgccagacaacattgaagaaagctggaaaataatggccttggatgccatcgctaaaacttgtacatttacggctatgtgttttgaaaatatgcgtattatgagatatgaagagtttatatccatgatattcaggctggattatacccaaccactttcagatgaatacatcacagtgactgatacaacatttgttgacattccagtacgattgtacttgccaaaaagaaagtcagaaacccgaaggcgagctgtgatatattttcatggtggtggtttttgttttggaagttccaaacagagggcttttgacttcctgaatagatggacggcaaacacgcttgatgctgttgttgtaggcgtggactataggctggctcctcaacaccactttcctgctcagtttgaagatggccttgctgcagtcaaattttttcttttggaaaaaattcttacaaaatatggagtggatcccacccgaatctgcatttcgggagacagttctgggggcaatttagcaacagcggtcactcaacaggtgcagaatgatgctgaaataaaacataaaatcaagatgcaggtcttactttaccctggcttacagataacagattcttatttgccatctcaccgagaaaatgagcatggtatagttttgaccagggatgtagccataaaactcgtgagcttatatttcaccaaggatgaagcacttccctgggcaatgagaagaaaccaacacatgcctctggagtcaagacatctgtttaagtttgttaactggagtattcttcttcctgagaagtatagaaaagactatgtatatactgaaccaattcttggaggacttagttattcattgccaggacttacagacagcagagcattacccttgttggccaatgattctcagttacagaatttgccactaacctatattcttacttgtcaacatgatctcttaagagatgatggacttatgtatgttacaagacttcgaaatgttggagtccaagttgttcatgaacatattgaggatggaattcatggagctttatcattcatgacttcaccattttatttacgtctaggtcttaggataagagatatgtatgtaagttggctggataagaatttataaatatgtgatgtgtatgtatagcccttacatagtggattgtaatttgtgatattttgtggttttggagcaaagaacaatgtcatttgagttatctaaatctacatttgcaacatttgtagcagttaatgtgtgtccttgaagagttattaaattttctgacttgcagaccccaaaaaaaaaaaaaaaaaaaaaaaaaaaaaa

SEQ ID NO: 846 - DNA, 912 bp, Homo sapiens
acagacctgccccgccatgacccggctgacagtcctggccctgctggctggtctgctggcgtcctcgagggccggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctg

SEQ ID NO: 847 - DNA, 534 bp, Homo sapiens
atggatcttgtaaaagtgaggaagaggcagaactggcgcaggactgtggaagggtgggcaagtgagaaacagatggtggtggtgtgcaaggagtccccaaaggagtatctccagcctttcaaggacaaactagaggagttcttccaaaaagggctcccaagacaattctggtctattcagagaaagggaatttatatgagggaaactggatcttatgacagggaagtaaagtccagtctacgagacaagcagaacactaaaatgggaactagtgtagcaaatgccaagcatccagtgaagtctgaaagggctagaagttcacctgaacacagttgtccttgctgccaacgcctgaaggtaacagaacgatacaaggctgagaagcagcttcccgtcctggataaagcaatgttccttgtactggaccacatcaacctgagtgagctcatcaagatcattagaaggtccttccagctcagtgctaatcaagccttcctcctggcggtgaacagacacagcattgtagcagagtga

SEQ ID NO: 848 - DNA, 636 bp, Homo sapiens
atggcccctgaggtggtggtagtcttcgtggaccaggccacgttctacgataagcattgtgacctggagagcctgggcatggtcctctacatcatgctgagtggctacctgcccttcgtgggtcactgcggggccaactgtggctgggaccggggtgaggtctgcagggtgtgccagaaaaagctgtttgaaagcatccaggaaggcaagtatgaatttcctgacaaagactgggcacacatctccagtctgcagagcaggcagcagcgtctgctctatggctccattcaggctttttcatctacgaaggccctgaagttcccaccaaccccccatttccctagggtcctcgaggaaaaagctttttccaaaggggttgtctttgaaaaggaaagcaatcacttgtcattttgcataattgcctgcagcaggaacatctcttcgctgggctccacctgctcagccgcctgcagatctgggatccggtgtgccctcaccgctctagcggtggctggggctgcagcctgcagggagaagcaagaagcatcagttgacagaggctgccgacccgtacctgttccctctctgctctgtcaccctcctctggcggtccttccaccttcctctgtcctctga

SEQ ID NO: 849 - DNA, 1496 bp, Homo sapiens
gagggtgcagggagcagacgggaggatctcaggccagggacgatggcggctctgcaggagaagaagacgtgtggccagcgcatggaggagttccagcgttactgctggaacccggacacggggcagatgctgggccgcaccctgtcccggtgggtgtggatcagcctgtactacgtggccttctacgtggtgatgactgggctcttcgccctgtgcctctatgtgctgatgcagacagtggacccgtacacaccggactaccaagaccagctacggtcaccaggggtaaccttaaggccggatgtttacggggagaaaggcctggaaattgtctacaacgtctctgataacagaacctgggcagacctcacacagactctccacgccttcctagcaggctactctccagcagcccaggaggacagcatcaactgcacctccgagcagtacttcttccaggagagtttccgcgctcccaaccacaccaagttctcctgcaagttcacggcagatatgctgcagaactgctcaggcctggcggatcccaacttcggctttgaagaaggaaagccatgttttattattaaaatgaacaggatcgtcaagttcctccccagcaacggctcggcccccagagtggactgcgccttcctggaccagccccgcgagctcggccagccgctgcaggtcaagtactaccctcccaacggcaccttcagtctgcactacttcccttattacgggaagaaagcccagccccactacagcaaccccctggtggcagcgaagctcctcaacatccccaggaacgctgaggtcgccatcgtgtgcaaggtcatggcggagcacgtgaccttcaacaatccccacgacccgtatgaagggaaagtggagttcaaactcaagattgagaagtgaaacggtttgcgcaggggtcctgggcacgcctgcggggtcgctcaaggacaccctcctggttgggcttaccttgcccgtcagttccctgccaaatcatccccaaagtggtttggagcaacggtgttgtcagtgtgcgaactccagagaagcgcccacatctgaaggacctgctcgcgagtatcagttcttccttgttgaattcttacagtttttagatggaatttgctgctataagaatgtccagctaccatgggaacgcaaggcagcaactctctaattaaccaggtcataaaaacgattcgtcttctatgtagacatcactttcttactataatttatttttctacacttcaatatgaactgccccccccacattaatataaaaactactaatgcactgatatgaaacacggcttacactaatgacattctgaattcttgcttttaaaattgcaattcctaagttgtaaacataaaatatattaaagttactcttattgtatgtaaaaaaagaaatcgtgtttcctgatatgggagaaattaaataaaaaccaaacgcttccttaaaaaaaaaaaaa

SEQ ID NO: 850 - DNA, 1628 bp, Homo sapiens
cgtgtgagggcaaggcaggggggatttgctctgccacaggctactggaaagcagctttttgcctcacagatgtccacaaaatgccttattttacaagactcattttgttcttgttttgcttgatggttctcgtggagagcagaaaacccaagaggaagcgatggacagggcaggtggaaatgcccaagccaagtcacttatataagaagaaccttgatgtgaccaagatccggaagggaaagcctcagcagcttctcagagtggacgagcacgacttcagcatgagacccgccttcggaggccctgccatcccggtgggcgtggacgtacaggtggagagcctggacagcatctccgaggtggacatggacttcactatgaccctgtacctgcggcattactggaaggatgagaggctagctttctccagcgccagcaacaagagcatgaccttcgatggccggctggtgaagaagatctgggtccctgatgtcttctttgttcactccaaaagatcgttcactcatgacaccaccactgacaacatcatgctgagggtgttcccagatggacacgtgctgtacagcatgaggattacggtcactgccatgtgcaacatggacttcagccactttcccctggactcccagacctgttctttggagctggagagctatgcctatacagatgaagatctaatgctgcactggaagaatggggatgaatccctaaaaacagatgagaagatctccttgtctcagtttctgattcagaaatttcacacaacttccaggctggccttctacagcagcactggctggtacaaccgtctgtacattaacttcacgttgcgtcgccacatcttcttcttcttgctccaaacatatttccctgccactctgatggtcatgctgtcctgggtgtccttctggatcgaccgcagagctgtgcctgccagagtttcactgggtatcacgacggtgctgaccatgaccaccatcatcacgggcgtgaatgcctccatgccgcgcgtctcctacgtcaaggccgtggacatctacctctgggtcagctttgtgttcgtgttcctctcggtgctggagtatgcggctgtcaactacctgaccaccgtgcaggagcgcaaggaacggaagctgcgggagaagttcccgtgcatgtgtggaatgcttcactcaaaaaccatgatgctggatggaagctacagtgagtctgaggccaacagcctggctgggtaccccagaagccatatcctgacagaagaagaaaggcaagacaaaatagtggtccacctgggcctgagtggtgaagccaacgctgccagaaagaaggggcttctgaagggccagacgggttttcgtatcttccagaatacccatgccattgacaaatactctaggttgatattccctgcctcctacatatttttcaacttaatttattggtcagtgttttcctaggggctccaaggctgttcctagaagagggcatagacatcgaggggggctggccagtcattgacagacggacttgttgaccacacgcccctcaccaaacaatgcagcagctactggaccaccctgagcagcactcatctctcagagaagccc

SEQ ID NO: 851 - DNA, 4670 bp, Homo sapiens
gcactcgctggaaagcggctccgagccaggggctattgcaaagccagggtgcgctaccggacggagaggggagagccctgagcagagtgagcaacatcgcagccaaggcggaggccgaagaggggcgccaggcaccaatctccgcgttgcctcagccccggaggcgccccagagcgcttcttgtcccagcagagccactctgcctgcgcctgcctctcagtgtctccaactttgcgctggaagaaaaacttcccgcgcgccggcagaactgcagcgcctccttttagtgactccgggagcttcggctgtagccggctctgcgcgcccttccaacgaataatagaaattgttaattttaacaatccagagcaggccaacgaggctttgctctcccgacccgaactaaaggtccctcgctccgtgcgctgctacgagcggtgtctcctggggctccaatgcagcgagctgtgcccgaggggttcggaaggcgcaagctgggcagcgacatggggaacgcggagcgggctccggggtctcggagctttgggcccgtacccacgctgctgctgctcgccgcggcgctactggccgtgtcggacgcactcgggcgcccctccgaggaggacgaggagctagtggtgccggagctggagcgcgccccgggacacgggaccacgcgcctccgcctgcacgcctttgaccagcagctggatctggagctgcggcccgacagcagctttttggcgcccggcttcacgctccagaacgtggggcgcaaatccgggtccgagacgccgcttccggaaaccgacctggcgcactgcttctactccggcaccgtgaatggcgatcccagctcggctgccgccctcagcctctgcgagggcgtgcgcggcgccttctacctgctgggggaggcgtatttcatccagccgctgcccgccgccagcgagcgcctcgccaccgccgccccaggggagaagccgccggcaccactacagttccacctcctgcggcggaatcggcagggcgacgtcggcggcacgtgcggggtcgtggacgacgagccccggccgactgggaaagcggagaccgaagacgaggacgaagggactgagggcgaggacgaaggggctcagtggtcgccgcaggacccggcactgcaaggcgtaggacagcccacaggaactggaagcataagaaagaagcgatttgtgtccagtcaccgctatgtggaaaccatgcttgtggcagaccagtcgatggcagaattccacggcagtggtctaaagcattaccttctcacgttgttttcggtggcagccagattgtacaaacaccccagcattcgtaattcagttagcctggtggtggtgaagatcttggtcatccacgatgaacagaaggggccggaagtgacctccaatgctgccctcactctgcggaacttttgcaactggcagaagcagcacaacccacccagtgaccgggatgcagagcactatgacacagcaattcttttcaccagacaggacttgtgtgggtcccagacatgtgatactcttgggatggctgatgttggaactgtgtgtgatccgagcagaagctgctccgtcatagaagatgatggtttacaagctgccttcaccacagcccatgaattaggccacgtgtttaacatgccacatgatgatgcaaagcagtgtgccagccttaatggtgtgaaccaggattcccacatgatggcgtcaatgctttccaacctggaccacagccagccttggtctccttgcagtgcctacatgattacatcatttctggataatggtcatggggaatgtttgatggacaagcctcagaatcccatacagctcccaggcgatctccctggcacctcgtacgatgccaaccggcagtgccagtttacatttggggaggactccaaacactgccccgatgcagccagcacatgtagcaccttgtggtgtaccggcacctctggtggggtgctggtgtgtcaaaccaaacacttcccgtgggcggatggcaccagctgtggagaagggaaatggtgtatcaacggcaagtgtgtgaacaaaaccgacagaaagcattttgatacgccttttcatggaagctggggaatgtgggggccttggggagactgttcgagaacgtgcggtggaggagtccagtacacgatgagggaatgtgacaacccagtcccaaagaatggagggaagtactgtgaaggcaaacgagtgcgctacagatcctgtaaccttgaggactgtccagacaataatggaaaaacctttagagaggaacaatgtgaagcacacaacgagttttcaaaagcttcctttgggagtgggcctgcggtggaatggattcccaagtacgctggcgtctcaccaaaggacaggtgcaagctcatctgccaagccaaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatatcaggatcagttactagtgcaaaacctggatatcatgatatcatcacaattccaactggagccaccaacatcgaagtgaaacagcggaaccagaggggatccaggaacaatggcagctttcttgccatcaaagctgctgatggcacatatattcttaatggtgactacactttgtccaccttagagcaagacattatgtacaaaggtgttgtcttgaggtacagcggctcctctgcggcattggaaagaattcgcagctttagccctctcaaagagcccttgaccatccaggttcttactgtgggcaatgcccttcgacctaaaattaaatacacctacttcgtaaagaagaagaaggaatctttcaatgctatccccactttttcagcatgggtcattgaagagtggggcgaatgttctaagtcatgtgaattgggttggcagagaagactggtagaatgccgagacattaatggacagcctgcttccgagtgtgcaaaggaagtgaagccagccagcaccagaccttgtgcagaccatccctgcccccagtggcagctgggggagtggtcatcatgttctaagacctgtgggaagggttacaaaaaaagaagcttgaagtgtctgtcccatgatggaggggtgttatctcatgagagctgtgatcctttaaagaaacctaaacatttcatagacttttgcacaatggcagaatgcagttaagtggtttaagtggtgttagctttgagggcaaggcaaagtgaggaagggctggtgcagggaaagcaagaaggctggagggatccagcgtatcttgccagtaaccagtgaggtgtatcagtaaggtgggattatgggggtagatagaaaaggagttgaatcatcagagtaaactgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatgggggttgggaaatgaaaagtaggagaaaagtgagattttactaagacctgttttactttacctcactaacaatggggggagaaaggagtacaaataggatctttgaccagcactgtttatggctgctatggtttcagagaatgtttatacattatttctaccgagaattaaaacttcagattgttcaacatgagagaaaggctcagcaacgtgaaataacgcaaatggcttcctctttccttttttggaccatctcagtctttatttgtgtaattcattttgaggaaaaaacaactccatgtatttattcaagtgcattaaagtctacaatggaaaaaaagcagtgaagcattagatgctggtaaaagctagaggagacacaatgagcttagtacctccaacttcctttctttcctaccatgtaaccctgctttgggaatatggatgtaaagaagtaacttgtgtctcatgaaaatcagtacaatcacacaaggaggatgaaacgccggaacaaaaatgaggtgtgtagaacagggtcccacaggtttggggacattgagatcacttgtcttgtggtggggaggctgctgaggggtagcaggtccatctccagcagctggtccaacagtcgtatcctggtgaatgtctgttcagctcttctgtgagaatatgattttttccatatgtatatagtaaaatatgttactataaattacatgtactttataagtattggtttgggtgttccttccaagaaggactatagttagtaataaatgcctataataacatatttatttttatacatttatttctaatgaaaaaaacttttaaattatatcgcttttgtggaagtgcatataaaatagagtatttatacaatatatgttactagaaataaaagaacacttttggaaaaaaaaaaaaaaaaaaaaa

SEQ ID NO: 852 - DNA, 1219 bp, Homo sapiens
gggagcgggcgagtaggagggggcgccgggctatatatatagcggcctcggcctcgggcgggcctggcgctcagggaggcgcgcactgctcctcagagtcccagctccagccgcgcgctttccgcccggctcgccgctccatgcagccggggtagagcccggcgcccgggggccccgtcgcttgcctcccgcacctcctcggttgcgcactcccgcccgaggtcggccgtgcgctcccgcgggacgccacaggcgcagctctgccccccagcttcccgggcgcactgaccgcctgaccgacgcacgccctcgggccgggatgtcggggcccgggacggccgcggtagcgctgctcccggcggtcctgctggccttgctggcgccctgggcgggccgagggggcgccgccgcacccactgcacccaacggcacgctggaggccgagctggagcgccgctgggagagcctggtggcgctctcgttggcgcgcctgccggtggcagcgcagcccaaggaggcggccgtccagagcggcgccggcgactacctgctgggcatcaagcggctgcggcggctctactgcaacgtgggcatcggcttccacctccaggcgctccccgacggccgcatcggcggcgcgcacgcggacacccgcgacagcctgctggagctctcgcccgtggagcggggcgtggtgagcatcttcggcgtggccagccggttcttcgtggccatgagcagcaagggcaagctctatggctcgcccttcttcaccgatgagtgcacgttcaaggagattctccttcccaacaactacaacgcctacgagtcctacaagtaccccggcatgttcatcgccctgagcaagaatgggaagaccaagaaggggaaccgagtgtcgcccaccatgaaggtcacccacttcctccccaggctgtgaccctccagaggacccttgcctcagcctcgggaagcccctgggagggcagtgcgagggtcaccttggtgcactttcttcggatgaagagtttaatgcaagagtaggtgtaagatatttaaattaattatttaaatgtgtatatattgccaccaaattatttatagttctgcgggtgtgttttttaattttctggggggaaaaaaagacaaaacaaaaaaccaactctgacttttctggtgcaacagtggagaatcttaccattggatttctttaacttgt

SEQ ID NO: 853 - DNA, 1238 bp, Homo sapiens
gtcatccatctgaaccagctcagcagcatccacaacatcctacaatggccttgactttttatttactggtcgccctagtggtgctcagctacaagtcattcagctctctgggctgtgatctgcctcagactcacagcctgggtaacaggagggccttgatactcctggcacaaatgcgaagaatctctcctttctcctgcctgaaggacagacatgactttgaattcccccaggaggagtttgatgataaacagttccagaaggctcaagccatctctgtcctccatgagatgatccagcagaccttcaacctcttcagcacaaaggactcatctgctgctttggatgagacccttctagatgaattctacatcgaacttgaccagcagctgaatgacctggagtcctgtgtgatgcaggaagtgggggtgatagagtctcccctgatgtacgaggactccatcctggctgtgaggaaatacttccaaagaatcactctatatctgacagagaagaaatacagctcttgtgcctgggaggttgtcagagcagaaatcatgagatccttctctttatcaatcaacttgcaaaaaagattgaagagtaaggaatgagacctggtacaacacggaaatgattcttatagactaatacagcagctcacacttcgacaagttgtgctctttcaaagacccttgtttctgccaaaaccatgctatgaattgaatcaaatgtgtcaagtgttttcaggagtgttaagcaacatcctgttcagctgtatgggcactagtcccttacagatgaccatgctgatggatctattcatctatttatttaaatctttatttagttaactatctatagggcttaaattagttttgttcatattatattatgtgaacttttatattgtgaattgtgtaacaaaaacatgttctttatatttattattttgccttgtttattaaatttttactatagaaaaattctttatttattctttaaaattgaactccaaccctgattgtgcaaactgattaaaggaagtggtgcacttgcaaacaagctctactatccctgaggaaataccagagactctggaaggtgatattcaaaaagcaaaaagcaaaattctaacactaattgaacctgacattaaaacagcacagatgactgctaccatagattcctgcctttcaaacgcagggcaagacattcattggtcatacgtagaaggc

SEQ ID NO: 854 - DNA, 1831 bp, Homo sapiens
gctggagtgcaatggtgaaattatagcagactgcagtcttcaactcctgacctcaagcaattgtcctgcctcctcaacttcctgactacaggtgtgcatgaggactacaggcaggcatgtgccaacacatgcagctttttttttttttttttttcagagatgtggtctcgctttgttgcctacactggtctcaaactcttggcctcaagggatcctcccacctcggcttcccaaagtgcagagattacagtctcattttctctctctctgcattaatcaagaatgagagaaccctccaggggacaagatgaaggggaaatagatgatgtgcaaagaaatccttgctttatgaggggaaaaagtgttcctcatgaagttcaacaaaatgatgcaggtaaagcagttagctagcacctggcacatggcagacactcatagctgcctaaggcattggagaactggatcgtgctgcagccagaggcacctgcagagcctcatgggctggctgctgcagggtgtggctgattgagagtgcttttgtgagttggcctgcagggtacacttggtaacgtgccacagctctcaggaaagtgacctaagttggatttttctgcatggacatagaattgcaaaaaattctcatttgcatggagatggggagtttatttttcctagaagctgcatgtcaagacccagaagaaagaggcatttcataataatgattaatcagctatatcttaaagaagaaagaaaacaattaaggaaatacaatactaagaaaacaaggggaaaaaacaatctccccaaggtggatccacccagcaaaccttgacagcatttcctcttatccacctgaataaaaatgaccagccctttccaaatggcagagagcactgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatga

SEQ ID NO: 855 - DNA, 1030 bp, Homo sapiens
tgcacacactgacaggagtccaagaatgtgcactgagggagcgtttccgcacagatctgcgtgttccttaccactcacacatgtgcacacacatatccatgtgtgtgtgccagtgctttggggctctgttccacggggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgttctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtaaagtcatatagtccatgtctgtgatgtgagccaagtgatatcctgtagtacacattgtactgagtggtttttctgaataaattccatattttacctatg

SEQ ID NO: 856 - DNA, 3779 bp, Homo sapiens
ttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactagttcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgagcgtcagcatgaccacatgctccacactgcttgccctcggaatgatgccgctgtgcctccttatctataccaaaatgtgggtcgactctgggagcatcgtaattccctatgataacataggtacatctctggttgctctcgttgttcctgtttccattggaatgtttgttaatcacaaatggccccaaaaagcaaagatcatacttaaaattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggattttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgagtttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttcagtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgtttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggcagcagggggtacagacttccttcttagagagtgtcagagaatatgctcccaatggtggaaaggaagatttacagtctagcggctaagtacctcctacacatttcccatcaatcagaaaatagacaggtacactaaagggacctgagaactcctcttgtaatttcaacacacccaaaatcaagggcctggatgccagcagctgcagcaagcaggtttttcctccctgttgagcaagacaggtgaggcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgt

SEQ ID NO: 857 - DNA, 2262 bp, Homo sapiens
gtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgaatgttggatgtgtacccaaaaaggtaatgtggaacacagctgtccactctgaattcatgcatgatcatgctgattatggctttccaagttgtgagggtaaattcaattggcgtgttattaaggaaaagcgggatgcctatgtgagccgcctgaatgccatctatcaaaacaatctcaccaagtcccatatagaaatcatccgtggccatgcagccttcacgagtgatcccaagcccacaatagaggtcagtgggaaaaagtacaccgccccacacatcctgatcgccacaggtggtatgccctccacccctcatgagagccagatccccggtgccagcttaggaataaccagcgatggattttttcagctggaagaattgcccggccgcagcgtcattgttggtgcaggttacattgctgtggagatggcagggatcctgtcagccctgggttctaagacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggggattcaaaccgatgacaagggtcatatcatcgtagacgaattccagaataccaacgtcaaaggcatctatgcagttggggatgtatgtggaaaagctcttcttactccagttgcaatagctgctggccgaaaacttgcccatcgactttttgaatataaggaagattccaaattagattataacaacatcccaactgtggtcttcagccacccccctattgggacagtgggactcacggaagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgctctcattgcccaggctggagtgcggtggtgctatttcagctcaccacaacctctgcctcctgggttcaagtgattctcctgccttagcctcccgaatagctggaattacaggcacgcaccaccatgcctgactaattttgtatttttagtagacatggggtttctccatgttggtcaggctggtctcaaactcccaccttcaggtgatccgcccacc

SEQ ID NO: 858 - DNA, 940 bp, Homo sapiens
ctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggagaaaaaaaaaaaaaaaaaaaaaaaaaaaaaaaaaaaaaaaaaaaaaaaaaaaaaaa

SEQ ID NO: 859 - DNA, 1347 bp, Homo sapiens
atggcggactacctgatcaccagcagcaccggctacgtgcccagggatgggctcactgtgccccagctcttcgtcggcgctgacggcctcacccacaacgacttcctgattcttccaggattcatagacttcatagctgatgaggtggacctgacctcagccctgacccagaaggtcacgctgaagacgccgctgatctcctcccctatggacactgtgacagaggctgacatggccatcgcgatggctctgatgggacctattggtttcattcaccacaactgtaccgcagagttccaggccaaggaggtacagaagatcaagaagtttgaacagggcttcatcacggaccccgtggtgctgagcccctcgcgcactgtgggtgatgtgctggaggccaagatgcggcatggcttctctggcatccccatcactagacgggcaccaagctggtgggcatcgtcacctcccgagacactgactttcttgctgagaaggacaacaccaccctcctcaaagaacagagactaccctctggcctccaaggattcccacaagcagctgctgtgcagggcagctgtgggcacccgtgaggatgacaaatactgcctggacctgctcttccaggcgggtctcaactcttggactcgtcccagggaactcggcacatcagatcaccatggtgcattacatcaaacaaaagtacccccacctccaggtgactggggggaacatggtgacagcagcccaggccaagaacctgacgctggtgtggatgggctgctagtgggcacgggctgtggctctatctgcatcacccaggaagtgatggcctgtggtcggccccagggcactgctatgtacaaggtggccgagtatgcctggcactttggtgtgcccatcatattcaatggtggcatccagatcgtggagcacatggtcaaggccctggcccttggagcctccacagtgatgacgggctccctgttggctgccaccatggaggcccccggtgagtacttcttctcagatggggtgtggctcaagaagtaccgtggcatgggctcgctggatgccatggggaagagcagcagcagccagaaacgatacttcggcgagggggataaggtgaagatcgcgcaggatgtctcaaactccatccaggacaaagggtccattcaaaacttcgtgtcctacctcatagtggacatccagcaaggctgccaggatagcagggcccacagcctgtctgccctttggtccatgatgtactcaggggagctcaagtttgagaagtggaccatattggcccagatcaagggtggcgtccacggcctgcattcttag

SEQ ID NO: 860 - DNA, 5189 bp, Homo sapiens
atggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtg

SEQ ID NO: 861 - DNA, 4361 bp, Homo sapiens
tcgtggggcgggggtggggcgggactgagggcggagtgtgagcgggctcggttttgggccgcggcgggagcgggagtcgccgccactcgagtgcgcaggcgcctggcgattaccggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtcgcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttgggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctaattcttttccaaacagtcccctgctttcatgtacagctttttctttaccttacccaaaattctggccttgaagcagttttcctctatggctttgcctttctgattttctcagaggctcgagtctttaatataaccccaaatgaaagaaccaaggggaggggtgggatggcacttttttttgttggtcttgttttgttttgttttttggttggttggttcgttattttttaagattagccattctctgctgctatttccctacataatgtcaatttttaaccataattttgacatgattgagatgtacttgaggcttttttgttttaattgagaaaagactttgcaattttttttttaggatgagcctctcctagacttgacctagaatattacatattcctccagtaagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattacaggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 862 - DNA, 4325 bp, Homo sapiens
tataaaatagtattccaaataagtacattttatagcaaaattatgcatttttcctaagactttcatcaccaatatcgccttataccctgcttttgttgggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagtctcccaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtctcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 863 - DNA, 2284 bp, Homo sapiens
cggtccctcccggcccggcggaacgcgtcccttttaagggggcggggacctgggggtctggggccagcgcgcgggagggacgcctgagtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagtggatgcagaatgtgctgggccaggtgctggacgcgctggaatacctgcaccatttggacatcatccacaggaatctcaaaccctccaacatcatcctcatcagcagtgaccactgcaaactgcaggacctgagttccaatgtgctaatgacagacaaagccaaatggaatattcgtgcggaggaagacccctttcgtaagtcctggatggcccctgaagccctcaacttctccttcagccagaaatcagacatctggtccctgggctgcatcattctggacatgaccagctgctccttcatggatggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaaggacgtggtgcacatcaccttcttgagaggctccttcaagtcctcgtgcgtctctctgaccctgcaccggcagatggtgcctgcgtccatcaccgacatgctgttagaaggcaacgtggccagcattttaggtgatgctggggacacaaagggggagcgtgccctgaagctcctgtccatggccttggcatcctattgtttagttccagagggttcattatttatgcccctggccttgctccacatgcacgaccagtggctcagctgtgaccaggacagagtccctgggaagagagactttgcctccctggggaaactagggaagctgttgggccccatcccaaagggtctgccgtggcccccggagctggtggaggtggtggtcacgaccatggagctacatgacagggtcctcgatgtccagctgtgtgcctgctccctgctgctgcacctcctgggccaaggtatcattgtgaacaaggcccccttggagaaggtcccggacctcatcagccaggtgttggccacctaccctgcggatggggaaatggcagaagccagctgcggagtcttctggctgctgtccctgctgggctgcatcaaggagcagcagtttgaacaagtggtggcgctgctcctgcaaagcatccggctgtgccaggacagagccctgctggtgaacaatgcctaccggggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaaaaaaaaaaa

SEQ ID NO: 864 - DNA, 2779 bp, Homo sapiens
actgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagtggatgcagaatgtgctgggccaggtgctggacgcgctggaatacctgcaccatttggacatcatccacaggaatctcaaaccctccaacatcatcctcatcagcagtgaccactgcaaactgcaggacctgagttccaatgtgctaatgacagacaaagccaaatggaatattcgtgcggaggaagacccctttcgtaagtcctggatggcccctgaagccctcaacttctccttcagccagaaatcagacatctggtccctgggctgcatcattctggacatgaccagctgctccttcatggatggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaaggacgtggtgcacatcaccttcttgagaggctccttcaagtcctcgtgcgtctctctgaccctgcaccggcagatggtgcctgcgtccatcaccgacatgctgttagaaggcaacgtggccagcattttagaggtcatgcagaaattctctggctggcccgaagtccagctcagggccatgaagaggcttctgaaaatgcctgcagatcagctaggtctgccgtggcccccggagctggtggaggtggtggtcacgaccatggagctacatgacagggtcctcgatgtccagctgtgtgcctgctccctgctgctgcacctcctgggccaagcgctggtgcaccacccggaagccaaggctccctgcaaccaagccatcacctccaccctgctgagtgctcttcagagccaccccgaggaggagccacttcttgtcatggtctacagcctgctagccatcaccacaacccaggagtcagagtcactgtcagaggagctgcagaacgctgggctgctggagcacatcctggagcacctcaacagctccctcaaaagcagggacgtctgcgccagcggcctgggcctgctctgggccctcctgctggacggtatcattgtgaacaaggcccccttggagaaggtcccggacctcatcagccaggtgttggccacctaccctgcggatggggaaatggcagaagccagctgcggagtcttctggctgctgtccctgctgggctgcatcaaggagcagcagtttgaacaagtggtggcgctgctcctgcaaagcatccggctgtgccaggacagagccctgctggtgaacaatgcctaccggggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggtgagtgacagcagcgccttcagcaaaccaggcctccctccaggtggaagcccccagctggggtgcaccacgtctgggggactggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcacctcacactcctcttaggtgactaataaagaggcccaaggccagtttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgca

SEQ ID NO: 865 - DNA, 2438 bp, Homo sapiens
cccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccaccaaaaaaaaaaaaaaaa

SEQ ID NO: 866 - DNA, 2070 bp, Homo sapiens; identical to SEQ ID NO: 359

SEQ ID NO: 867 - protein, 412 aa, Homo sapiens
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 868 - protein, 433 aa, Homo sapiens
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 869 - protein, 501 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 870 - protein, 461 aa, Homo sapiens [sequence omitted]

SEQ ID NO: 871 - protein, 467 aa, Homo sapiens
MASVAAARAVPVGSGLRGLQRTLPLVVILGATGTGKSTLALQLGQRLGGEIVSADSMQVYEGLDIITNKVSAQEQRICRHHMISFVDPLVTNYTVVDFRNRATALIEDIFARDKIPIVVGGTNYYIESLLWKVLVNTKPQEMGTEKVIDRKVELEKEDGLVLHKRLSQVDPEMAAKLHPHDKRKVARSLQVFEETGISHSEFLHRQHTEEGGGPLGGPLKFSNPCILWLHADQAVLDERLDKRVDDMLAAGLLEELRDFHRRYNQKNVSENSQDYQHGIFQSIGFKEFHEYLITEGKCTLETSNQLLKKGIEALKQVTKRYARKQNRWVKNRFLSRPGPIVPPVYGLEVSDVSKWEESVLEPALEIVQSFIQGHKPTATPIKMPYNEAENKRSYHLCDLCDRIIIGDREWAAHIKSKSHLNQLKKRRRLDSDAVNTIESQSVSPDHNKEPKEKGSPGQNDQELKCSV

SEQ ID NO: 872 - protein, 890 aa, Homo sapiens
MSANNSPPSAQKSVLPTAIPAVLPAASPCSSPKTGLSARLSNGSFSAPSLTNSRGSVHTVSFLLQIGLTRESVTIEAQELSLSAVKDLVCSIVYQKFPECGFFGMYDKILLFRHDMNSENILQLITSADEIHEGDLVEVVLSALATVEDFQIRPHTLYVHSYKAPTFCDYCGEMLWGLVRQGLKCEGCGLNYHKRCAFKIPNNCSGVRKRRLSNVSLPGPGLSVPRPLQPEYVALPSEESHVHQEPSKRIPSWSGRPIWMEKMVMCRVKVPHTFAVHSYTRPTICQYCKRLLKGLFRQGMQCKDCKFNCHKRCASKVPRDCLGEVTFNGEPSSLGTDTDIPMDIDNNDINSDSSRGLDDTEEPSPPEDKMFFLDPSDLDVERDEEAVKTISPSTSNNIPLMRVVQSIKHTKRKSSTMVKEGWMVHYTSRDNLRKRHYWRLDSKCLTLFQNESGSKYYKEIPLSEILRISSPRDFTNISQGSNPHCFEIITDTMVYFVGENNGDSSHNPVLAATGVGLDVAQSWEKAIRQALMPVTPQASVCTSPGQGKDHKDLSTSISVSNCQIQENVDISTVYQIFADEVLGSGQFGIVYGGKHRKTGRDVAIKVIDKMRFPTKQESQLRNEVAILQNLHHPGIVNLECMFETPERVFVVMEKLHGDMLEMILSSEKSRLPERITKFMVTQILVALRNLHFKNIVHCDLKPENVLLASAEPFPQVKLCDFGFARIIGEKSFRRSVVGTPAYLAPEVLRSKGYNRSLDMWSVGVIIYVSLSGTFPFNEDEDINDQIQNAAFMYPPNPWREISGEAIDLINNLLQVKMRKRYSVDKSLSHPWLQDYQTWLDLREFETRIGERYITHESDDARWEIHAYTHNLVYPKHFIMAPNPDDMEEDP

SEQ ID NO: 873 - protein, 540 aa, Homo sapiens
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 874 - protein, 342 aa, Homo sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 875 - protein, 402 aa, Homo sapiens
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 876 - protein, 520 aa, Homo sapiens
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKQKSTKKFWIQKLPKVLCLHLKRFHWTAYLRNKVDTYVEFPLRGLDMKCYLLEPENSGPESCLYDLAAVVVHHGSGVGSGHYTAYATHEGRWFHFNDSTVTLTDEETVVKAKAYILFYVEHQAKAGSDKL

SEQ ID NO: 877 - protein, 1084 aa, Homo sapiens
MEQPKGVDWTVIILTCQYKDSVQVFQRELEVRQKREQIPAGTLLLAVEDPEKRVGSGGATLNALLVAAEHLSARAGFTVVTSDVLHSAWILILHMGRDFPFDDCGRAFTCLPVENPEAPVEALVCNLDCLLDIMTYRLGPGSPPGVWVCSTDMLLSVPANPGISWDSFRGARVIALPGSPAYAQNHGVYLTDPQGLVLDIYYQGTEAEIQRCVRPDGRVPLVSGVVFFSVETAERLLATHVSPPLDACTYLGLDSGARPVQLSLFFDILHCMAENVTREDFLVGRPPELGQGDADVAGYLQSARAQLWRELRDQPLTMAYVSSGSYSYMTSSASEFLLSLTLPGAPGAQIVHSQVEEQQLLAAGSSVVSCLLEGPVQLGPGSVLQHCHLQGPIHIGAGCLVTGLDTAHSKALHGRELRDLVLQGHHTRLHGSPGHAFTLVGRLDSWERQGAGTYLNVPWSEFFKRTGVRAWDLWDPETLPAEYCLPSARLFPVLHPSRELGPQDLLWMLDHQEDGGEALRAWRASWRLSWEQLQPCLDRAATLASRRDLFFRQALHKARHVLEARQDLSLRPLIWAAVREGCPGPLLATLDQVAAGAGDPGVAARALACVADVLGCMAEGRGGLRSGPAANPEWMRPFSYLECGDLAAGVEALAQERDKWLSRPALLVRAARHYEGAGQILIRQAVMSAQHFVSTEQVELPGPGQWVVAECPARVDFSGGWSDTPPLAYELGGAVLGLAVRVDGRRPIGARARRIPEPELWLAVGPRQDEMTVKIVCRCLADLRDYCQPHAPGALLKAAFICAGIVHVHSELQLSEQLLRTFGGGFELHTWSELPHGSGLGTSSILAGTALAALQRAAGRVVGTEALIHAVLHLEQVLTTGGGWQDQVGGLMPGIKVGRSRAQLPLKVEVEEVTVPEGFVQKLNDHLLLVYTGKTRLARNLLQDVLRSWYARLPAVVQNAHSLVRQTEECAEGFRQGSLPLLGQCLTSYWEQKKLMAPGCEPLTVRRMMDVLAPHVHGQSLAGAGGGGFLYLLTKEPQQKEALEAVLAKTEGLGNYSIHLVEVDTQGLSLKLLGTEASTCCPFP

SEQ ID NO: 878 - protein, 421 aa, Homo sapiens
MTSQEKTEEYPFADIFDEDETERNFLLSKPVCFVVFGKPGVGKTTLARYITQAWKCIRVEALPILEEQIAAETESGVMLQSMLISGQSIPDELVIKLMLEKLNSPEVCHFGYIITEIPSLSQDAMTTLQQIELIKNLNLKPDVIINIKCPDYDLCQRISGQRQHNNTGYIYSRDQWDPEVIENHRKKKKEAQKDGKGEEEEEEEEQEEEEAFIAEMQMVAEILHHLVQRPEDYLENVENIVKLYKETILQTLEEVMAEHNPQYLIELNGNKPAEELFMIVMDRLKYLNLKRAAILTKLQGAEEEINDTMENDELFRTLASYKLIAPRYRWQRSKWGRTCPVNLKDGNIYSGLPDYSVSFLGKIYCLSSEEALKPFLLNPRPYLLPPMPGPPCKVFILGPQYSGKTTLCNMLAENYKGKVTN

SEQ ID NO: 879 - protein, 732 aa, Homo sapiens
MSETSRTAFGGRRAVPPNNSNAAEDDLPTVELQGVVPRGVNLQEFLNVTSVHLFKERWDTNKVDHHTDKYENNKLIVRRGQSFYVQIDLSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVQFTNPLKETLRNVWVHLDGPGVTRPMKKMFREIRPNSTVQWEEVCRPWVSGHRKLIASMSSDSLRHVYGELDVQIQRRPSM

SEQ ID NO: 880 - protein, 205 aa, Homo sapiens
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 881 - protein, 633 aa, Homo sapiens
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 882 - protein, 1042 aa, Homo sapiens
MDKILEGLVSSSHPLPLKRVIVRKVVESAEHWLDEAQCEAMFDLTTRLILEGQDPFQRQVGHQVLEAYARYHRPEFESFFNKTFVLGLLHQGYHSLDRKDVAILDYIHNGLKLIMSCPSVLDLFSLLQVEVLRMVCERPEPQLCARLSDLLTDFVQCIPKGKLSITFCQQLVRTIGHFQCVSTQERELREYVSQVTKVSNLLQNIWKAEPATLLPSLQEVFASISSTDASFEPSVALASLVQHIPLQMITVLIRSLTTDPNVKDASMTQALCRMIDWLSWPLAQHVDTWVIALLKGLAAVQKFTILIDVTLLKIELVFNRLWFPLVRPGALAVLSHMLLSFQHSPEAFHLIVPHVVNLVHSFKNDGLPSSTAFLVQLTELIHCMMYHYSGFPDLYEPILEAIKDFPKPSEEKIKLILNQSAWTSQSNSLASCLSRLSGKSETGKTGLINLGNTCYMNSVIQALFMATDFRRQVLSLNLNGCNSLMKKLQHLFAFLAHTQREAYAPRIFFEASRPPWFTPRSQQDCSEYLRFLLDRLHEEEKILKVQASHKPSEILECSETSLQEVASKAAVLTETPRTSDGEKTLIEKMFGGKLRTHIRCLNCRSTSQKVEAFTDLSLAFCPSSSLENMSVQDPASSPSIQDGGLMQASVPGPSEEPVVYNPTTAAFICDSLVNEKTIGSPPNEFYCSENTSVPNESNKILVNKDVPQKPGGETTPSVTDLLNYFLAPEILTGDNQYYCENCASLQNAEKTMQITEEPEYLILTLLRFSYDQKYHVRRKILDNVSLPLVLELPVKRITSFSSLSESWSVDVDFTDLSENLAKKLKPSGTDEASCTKLVPYLLSSVVVHSGISSESGHYYSYARNITSTDSSYQMYHQSEALALASSQSHLLGRDSPSAVFEQDLENKEMSKEWFLFNDSRVTFTSFQSVQKITSRFPKDTAYVLLYKKQHSTNGLSGNNPTSGLWINGDPPLQKELMDAITKDNKLYLQEQELNARARALQAASASCSFRPNGFDDNDPPGSCGPTGGGGGGGFNTVGRLVF

SEQ ID NO: 883 - protein, 2563 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEVKKATSVQQIEMEESKEPDDQDAPDEHESPPPEDAPLYPHSPGSQYQQNNHVHGQPYTGPAAHHMNNPQRTGQRAQENYEGSEEVSPPQTKDQ

SEQ ID NO: 884 - protein, 2547 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHLFDCFKASWTNASKKQREKLLELIRRLAEDDKDGVMAHKVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLATYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLLNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYILFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYTYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 885 - protein, 1042 aa, Homo sapiens; identical to SEQ ID NO: 882

SEQ ID NO: 886 - protein, 318 aa, Homo sapiens
MPKRGKKGAVAEDGDELRTEPEAKKSKTAAKKNDKEAAGEGPALYEDPPDQKTSPSGKPATLKICSWNVDGLRAWIKKKGLDWVKEEAPDILCLQETKCSENKLPAELQELPGLSHQYWSAPSDKEGYSGVGLLSRQCPLKVSYGIGDEEHDQEGRVIVAEFDSFVLVTAYVPNAGRGLVRLEYRQRWDEAFRKFLKGLASRKPLVLCGDLNVAHEEIDLRNPKGNKKNAGFTPQERQGFGELLQAVPLADSFRHLYPNTPYAYTFWTYMMNARSKNVGWRLDYFLLSHSLLPALCDSKIRSKALGSDHCPITLYLAL

SEQ ID NO: 887 - protein, 318 aa, Homo sapiens; identical to SEQ ID NO: 886

SEQ ID NO: 888 - protein, 318 aa, Homo sapiens; identical to SEQ ID NO: 886

SEQ ID NO: 889 - protein, 1207 aa, Homo sapiens
MRLTHICCCCLLYQLGFLSNGIVSELQFAPDREEWEVVFPALWRREPVDPAGGSGGSADPGWVRGVGGGGSARAQAAGSSREVRSVAPVPLEEPVEGRSESRLRPPPPSEGEEDEELESQELPRGSSGAAALSPGAPASWQPPPPPQPPPSPPPAQHAEPDGDEVLLRIPAFSRDLYLLLRRDGRFLAPRFAVEQRPNPGPGPTGAASAPQPPAPPDAGCFYTGAVLRHPGSLASFSTCGGGLMGFIQLNEDFIFIEPLNDTMAITGHPHRVYRQKRSMEEKVTEKSALHSHYCGIISDKGRPRSRKIAESGRGKRYSYKLPQEYNIETVVVADPAMVSYHGADAARRFILTILNMVFNLFQHKSLGVQVNLRVIKLILLHETPPELYIGHHGEKMLESFCKWQHEEFGKKNDIHLEMSTNWGEDMTSVDAAILITRKDFCVHKDEPCDTVGIAYLSGMCSEKRKCIIAEDNGLNLAFTIAHEMGHNMGINHDNDHPSCADGLHIMSGEWIKGQNLGDVSWSRCSKEDLERFLRSKASNCLLQTNPQSVNSVMVPSKLPGMTYTADEQCQILFGPLASFCQEMQHVICTGLWCKVEGEKECRTKLDPPMDGTDCDLGKWCKAGECTSRTSAPEHLAGEWSLWSPCSRTCSAGISSRERKCPGLDSEARDCNGPRKQYRICENPPCPAGLPGFRDWQCQAYSVRTSSPKHILQWQAVLDEEKPCALFCSPVGKEQPILLSEKVMDGTSCGYQGLDICANGRCQKVGCDGLLGSLAREDHCGVCNGNGKSCKIIKGDFNHTRGAGYVEVLVIPAGARRIKVVEEKPAHSYLALRDAGKQSINSDWKIEHSGAFNLAGTTVHYVRRGLWEKISAKGPTTAPLHLLVLLFQDQNYGLHYEYTIPSDPLPENQSSKAPEPLFMWTHTSWEDCDATCGGGERKTTVSCTKIMSKNISIVDNEKCKYLTKPEPQIRKCNEQPCQTRWMMTEWTPCSRTCGKGMQSRQVACTQQLSNGTLIRARERDCIGPKPASAQRCEGQDCMTVWEAGVWSECSVKCGKGIRHRTVRCTNPRKKCVLSTRPREAEDCEDYSKCYVWRMGDWSKCSITCGKGMQSRVIQCMHKITGRHGNECFSSEKPAAYRPCHLQPCNEKINVNTITSPRLAALTFKCLGDQWPVYCRVIREKNLCQDMRWYQRCCETCRDFYAQKLQQKS

SEQ ID NO: 890 - protein, 859 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTE

SEQ ID NO: 891 - protein, 870 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 892 - protein, 823 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTE

SEQ ID NO: 893 - protein, 899 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRSNGLSHSWSERIPDTKHISDICENGRPRSNSWQGNLGGNKKKIRGKRFRPRSNSTEYLNPWFKRDYNVAKWVEDVNKNTEGPYFRTLSPAKSPSSSTGSIASSRKYPYPMPPLPDEDKKVNRQSARLWETSI

SEQ ID NO: 894 - protein, 906 aa, Homo sapiens
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 895 - protein, 426 aa, Homo sapiens [sequence omitted]

SEQ ID NO: 896 - protein, 779 aa, Homo sapiens [sequence omitted]

SEQ ID NO: 897 - protein, 439 aa, Homo sapiens [sequence omitted]

SEQ ID NO: 898 - protein, 559 aa, Homo sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 899 - protein, 536 aa, Homo sapiens
MAEHAPRRCCLGWDFSTQQVKVVAVDAELNVFYEESVHFDRDLPEFGTQGGVHVHKDGLTVTSPVLMWVQALDIILEKMKASGFDFSQVLALSGAGQQHGSIYWKAGAQQALTSLSPDLRLHQQLQDCFSISDCPVWMDSSTTAQCRQLEAAVGGAQALSCLTGSRAYERFTGNQIAKIYQQNPEAYSHTERISLVSSFAASLFLGSYSPIDYSDGSGMNLLQIQDKVWSQACLGACAPHLEEKLSPPVPSCSVVGAISSYYVQRYGFPPGCKVVAFTGDNPASLAGMRLEEGDIAVSLGTSDTLFLWLQEPMPALEGHIFCNPVDSQHYMALLCFKNGSLMREKIRNESVSRSWSDFSKALQSTEMGNGGNLGFYFDVMEITPEIIGRHRFNTENHKVAAFPGDVEVRALIEGQFMAKRIHAEGLGYRVMSKTKILATGGASHNREILQVLADVFDAPVYVIDTANSACVGSAYRAFHGLAGGTDVPFSEVVKLAPNPRLAATPSPGASQVYEALLPQYAKLEQRILSQTRGPPE

SEQ ID NO: 900 - protein, 647 aa, Homo sapiens
MAAILGDTIMVAKGLVKLTQAAVETHLQHLGIGGELIMAARALQSTAVEQIGMFLGKVQGQDKHEEYFAENFGGPEGEFHFSVPHAAGASTDFSSASAPDQSAPPSLGHAHSEGPAPAYVASGPFREAGFPGQASSPLGRANGRLFANPRDSFSAMGFQRRFFHQDQSPVGGLTAEDIEKARQAKARPENKQHKQTLSEHARERKVPVTRIGRLANFGGLAVGLGFGALAEVAKKSLRSEDPSGKKAVLGSSPFLSEANAERIVRTLCKVRGAALKLGQMLSIQDDAFINPHLAKIFERVRQSADFMPLKQMMKTLNNDLGPNWRDKLEYFEERPFAAASIGQVHLARMKGGREVAMKIQYPGVAQSINSDVNNLMAVLNMSNMLPEGLFPEHLIDVLRRELALECDYQREAACARKFRDLLKGHPFFYVPEIVDELCSPHVLTTELVSGFPLDQAEGLSQEIRNEICYNILVLCLRELFEFHFMQTDPNWSNFFYDPQQHKVALLDFGATREYDRSFTDLYIQIIRAAADRDRETVRAKSIEMKFLTGYEVKVMEDAHLDAILILGEAFASDEPFDFGTQSTTEKIHNLIPVMLRHRLVPPPEETYSLHRKMGGSFLICSKLKARFPCKAMFEEAYSNYCKRQAQQ

SEQ ID NO: 901 - protein, 505 aa, Homo sapiens
MSNICQRLWEYLEPYLPCLSTEADKSTVIENPGALCSPQSQRHGHYFVALFDYQARTAEDLSFRAGDKLQVLDTLHEGWWFARHLEKRRDGSSQQLQGYIPSNYVAEDRSLQAEPWFFGAIGRSDAEKQLLYSENKTGSFLIRESESQKGEFSLSVLDGAVVKHYRIKRLDEGGFFLTRRRIFSTLNEFVSHYTKTSDGLCVKLGKPCLKIQVPAPFDLSYKTVDQWEIDRNSIQLLKRLGSGQFGEVWEGLWNNTTPVAVKTLKPGSMDPNDFLREAQIMKNLRHPKLIQLYAVCTLEDPIYIITELMRHGSLQEYLQNDTGSKIHLTQQVDMAAQVASGMAYLESRNYIHRDLAARNVLVGEHNIYKVADFGLARVFKVDNEDIYESRHEIKLPVKWTAPEAIRSNKFSIKSDVWSFGILLYEIITYGKMPYSGMTGAQVIQMLAQNYRLPQPSNCPQQFYNIMLECWNAEPKERPTFETLRWKLEDYFETDSSYSDANNFIR

SEQ ID NO: 902 - protein, 1079 aa, Homo sapiens
MVCSAAPLLLLATTLPLLGSPVAQASQPVSETGVRPREGLQRRQWGPLIGRDKAWNERIDRPFPACPIPLSSSFGRWPKGQTMWAQTSTLTLTEEELGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLVSCCLQILSCASKSMSEGIPWPSSEDMGTARS

SEQ ID NO: 903 - protein, 1050 aa, Homo sapiens
MEPGRGGTETVGKFEFSRKDLIGHGAFAVVFKGRHREKHDLEVAVKCINKKNLAKSQTLLGKEIKILKELKHENIVALYDFQEMANSVYLVMEYCNGGDLADYLHAMRTLSEDTIRLFLQQIAGAMRLLHSKGIIHRDLKPQNILLSNPAGRRANPNSIRVKIADFGFARYLQSNMMAATLCGSPMYMAPEVIMSQHYDGKADLWSIGTIVYQCLTGKAPFQASSPQDLRLFYEKNKTLVPTIPRETSAPLRQLLLALLQRNHKDRMDFDEFFHHPFLDASPSVRKSPPVPVPSYPSSGSGSSSSSSSTSHLASPPSLGEMQQLQKTLASPADTAGFLHSSRDSGGSKDSSCDTDDFVMVPAQFPGDLVAEAPSAKPPPDSLMCSGSSLVASAGLESHGRTPSPSPPCSSSPSPSGRAGPFSSSRCGASVPIPVPTQVQNYQRIERNLQSPTQFQTPRSSAIRRSGSTSPLGFARASPSPPAHAEHGGVLARKMSLGGGRPYTPSPQVGTIPERPGWSGTPSPQGAEMRGGRSPRPGSSAPEHSPRTSGLGCRLHSAPNLSDLHVVRPKLPKPPTDPLGAVFSPPQASPPQPSHGLQSCRNLRGSPKLPDFLQRNPLPPILGSPTKAVPSFDFPKTPSSQNLLALLARQGVVMTPPRNRTLPDLSEVGPFHGQPLGPGLRPGEDPKGPFGRSFSTSRLTDLLLKAAFGTQAPDPGSTESLQEKPMEIAPSAGFGGSLHPGARAGGTSSPSPVVFTVGSPPSGSTPPQGPRTRMFSAGPTGSASSSARHLVPGPCSEAPAPELPAPGHGCSFADPIAANLEGAVTFEAPDLPEETLMEQEHTEILRGLRFTLLFVQHVLEIAALKGSASEAAGGPEYQLQESVVADQISLLSREWGFAEQLVLYLKVAELLSSGLQSAIDQIRAGKLCLSSTVKQVVRRLNELYKASVVSCQGLSLRLQRFFLDKQRLLDRIHSITAERLIFSHAVQMVQSAALDEMFQHREGCVPRYHKALLLLEGLQHMLSDQADIENVTKCKLCIERRLSALLTGICA

SEQ ID NO: 904 - protein, 796 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 905 - protein, 483 aa, Homo sapiens
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 906 - protein, 551 aa, Homo sapiens
MAGDLSAGFFMEELNTYRQKQGVVLKYQELPNSGPPHDRRFTFQVIIDGREFPEGEGRSKKEAKNAAAKLAVEILNKEKKAVSPLLLTTTNSSEGLSMGNYIGLINRIAQKKRLTVNYEQCASGVHGPEGFHYKCKMGQKEYSIGTGSTKQEAKQLAAKLAYLQILSEETSVKSDYLSSGSFATTCESQSNSLVTSTLASESSSEGDFSADTSEINSNSDSLNSSSLLMNGLRNNQRKAKRSLAPRFDLPDMKETKYTVDKRFGMDFKEIELIGSGGFGQVFKAKHRIDGKTYVIKRVKYNNEKAEREVKALAKLDHVNIVHYNGCWDGFDYDPETSDDSLESSDYDPENSKNSSRSKTKCLFIQMEFCDKGTLEQWIEKRRGEKLDKVLALELFEQITKGVDYIHSKKLIHRDLKPSNIFLVDTKQVKIGDFGLVTSLKNDGKRTRSKGTLRYMSPEQISSQDYGKEVDLYALGLILAELLHVCDTAFETSKFFTDLRDGIISDIFDKKEKTLLQKLLSKKPEDRPNTSEILRTLTVWKKSPEKNERHTC

SEQ ID NO: 907 - protein, 1315 aa, Homo sapiens
MEKYHVLEMIGEGSFGRVYKGRRKYSAQVVALKFIPKLGRSEKELRNLQREIEIMRGLRHPNIVHMLDSFETDKEVVVVTDYAEGELFQILEDDGKLPEDQVQAIAAQLVSALYYLHSHRILHRDMKPQNILLAKGGGIKLCDFGFARAMSTNTMVLTSIKGTPLYMSPELVEERPYDHTADLWSVGCILYELAVGTPPFYATSIFQLVSLILKDPVRWPSTISPCFKDFLQGLLTKDPRQRLSWPDLLYHPFIAGHVTIITEPAGPDLGTPFTSRLPPELQVLKDEQAHRLAPKGNQSRILTQAYKRMAEEAMQKKHQNTGPALEQEDKTSKVAPGTAPLPRLGATPQESSLLAGILASELKSSWAKSGTGEVPSAPRENRTTPDCERAFPEERPEVLGQRSTDVVDLENEEPDSDNEWQHLLETTEPVPIQLKAPLTLLCNPDFCQRIQSQLHEAGGQILNGILEGASHILPAFRVLSSLLSSCSDSVALYSFCREAGLPGLLLSLLRHSQESNSLQQQSWYGTFLQDLMAVIQAYFACTFNLERSQTSDSLQVFQEAANLFLDLLGKLLAQPDDSEQTLRRDSLMCFTVLCEAMDGNSRAISKAFYSSLLTTQQVVLDGLLHGLTVPQLPVHTPQGAPQVSQPLREQSEDIPGAISSALAAICTAPVGLPDCWDAKEQVCWHLANQLTEDSSQLRPSLISGLQHPILCLHLLKVLYSCCLVSEGLCRLLGQEPLALESLFMLIQGKVKVVDWEESTEVTLYFLTLLVFRLQNLPCGMEKLGSDVATLFTHSHVVSLVSAAACLLGQLGQQGVTFDLQPMEWMAAATHALSAPAEVRLTPPGSCGFYDGLLILLLQLLTEQGKASLIRDMSSSEMWTVLWHRFSMVLRLPEEASAQEGELSLSSPPSPEPDWTLISPQGMAALLSLAMATFTQEPQLCLSCLSQHGSILMSILKHLLCPSFLNQLRQAPHGSEFLPVVVLSVCQLLCFPFALDMDADLLIGVLADLRDSEVAAHLLQVCCYHLPLMQVELPISLLTRLALMDPTSLNQFVNTVSASPRTIVSFLSVALLSDQPLLTSDLLSLLAHTARVLSPSHLSFIQELLAGSDESYRPLRSLLGHPENSVRAHTYRLLGHLLQHSMALRGALQSQSGLLSLLLLGLGDKDPVVRCSASFAVGNAAYQAGPLGPALAAAVPSMTQLLGDPQAGIRRNVASALGNLGPEGLGEELLQCEVPQRLLEMACGDPQPNVKEAALIALRSLQQEPGIHQVLVSLGASEKLSLLSLGNQSLPHSSPRPASAKHCRKLIHLLRPAHSM

SEQ ID NO: 908 - protein, 1036 aa, Homo sapiens
MALRGAAGATDTPVSSAGGAPGGSASSSSTSSGGSASAGAGLWAALYDYEARGEDELSLRRGQLVEVLSQDAAVSGDEGWWAGQVQRRLGIFPANYVAPCRPAASPAPPPSRPSSPVHVAFERLELKELIGAGGFGQVYRATWQGQEVAVKAARQDPEQDAAAAAESVRREARLFAMLRHPNIIELRGVCLQQPHLCLVLEFARGGALNRALAAANAAPDPRAPGPRRARRIPPHVLVNWAVQIARGMLYLHEEAFVPILHRDLKSSNILLLEEIEHDDICNKTLKITDFGLAREWHRTTKMSTAGTYAWMAPEVIKSSLFSKGSDIWSCGVLLWELLTGEVPYRGIDGLAVAYGVAVNKLTLPIPSTCPEPFAKLMKECWQQDPHIRPSFALILEQLTAIEGAVMTEMPQESFHSMQDDWKLEIQQMFDELRTKEKELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQLTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAGSWEEAASANAATVTIEMAPTNSLSRSPQRKKTESALYGCTVLLASVALGLDLRELHKAQAAEEPLPKEEKKKREGIFQRASKSRRSASPPTSLSSTCGEASSPPSLPLSSALGILSTPSFSTKCLLQMDSEDPLVDSAPVTCDSEMLTPDFCPTAPGSGREPALMPRLDTDCSVSRNLPSSFLQRTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDVDVEGQSRDYTVPLGRMRSKTSRPSIYELEKEFLS

SEQ ID NO: 909 - protein, 416 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 910 - protein, 416 aa, Homo sapiens; identical to SEQ ID NO: 909

SEQ ID NO: 911 - protein, 1078 aa, Homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 912 - protein, 328 aa, Homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 913 - protein, 520 aa, Homo sapiens
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 914 - protein, 446 aa, Homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 915 - protein, 400 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 916 - protein, 208 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISKDPHSTEQSVQQCQAWLPPTNPLS

SEQ ID NO: 917 - protein, 327 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGPESHHSAQAQLRSSKTQQWQIIDIFEAGAPATSGSATSGEEGNPNGGHCAWGLHCLLAALLLDPCSQYPLPDMPRVPRALQCHDMAGLRE

SEQ ID NO: 918 - protein, 367 aa, Homo sapiens
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLMPLREKKATQMVAIVLGAFIVCWLPFFLTHVLNTHCQTCHVSPELYSATTWLGYVNSALNPVIYTTFNIEFRKAFLKILSC

SEQ ID NO: 919 - protein, 372 aa, Homo sapiens
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 920 - protein, 407 aa, Homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 921 - protein, 565 aa, Homo sapiens
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 922 - protein, 399 aa, Homo sapiens
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 923 - protein, 399 aa, Homo sapiens; identical to SEQ ID NO: 922

SEQ ID NO: 924 - protein, 350 aa, Homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 925 - protein, 585 aa, Homo sapiens
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 926 - protein, 787 aa, Homo sapiens
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 927 - protein, 325 aa, Homo sapiens
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 928 - protein, 337 aa, Homo sapiens
MLRNNLGNSSDSKNEDGSVFSQTEHNIVATYLIMAGMISIISNIIVLGIFIKYKELRTPTNAIIINLAVTDIGVSSIGYPMSAASDLYGSWKFGYAGCQVYAGLNIFFGMASIGLLTVVAVDRYLTICLPDVGRRMTTNTYIGLILGAWINGLFWALMPIIGWASYAPDPTGATCTINWRKNDRSFVSYTMTVIAINFIVPLTVMFYCYYHVTLSIKHHTTSDCTESLNRDWSDQIDVTKMSVIMICMFLVAWSPYSIVCLWASFGDPKKIPPPMAIIAPLFAKSSTFYNPCIYVVANKKFRRAMLAMFKCQTHQTMPVTSILPMDVSQNPLASGRI

SEQ ID NO: 929 - protein, 969 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 930 - protein, 956 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 931 - protein, 975 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQAAVSSKGVPGGQSLAASSPGAGEGMLHHPTVDRSPFTELLRGLRPFVHWMHICWVPAVGRHRAAAG

SEQ ID NO: 932 - protein, 962 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRYGPPGGERQAAVSSKGVPGGQSLAASSPGAGEGMLHHPTVDRSPFTELLRGLRPFVHWMHICWVPAVGRHRAAAG

SEQ ID NO: 933 - protein, 487 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKGAAVAFWWTIGWPWNV

SEQ ID NO: 934 - protein, 623 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGNLD

SEQ ID NO: 935 - protein, 652 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEEREPGLKHVFRWQIEQELW

SEQ ID NO: 936 - protein, 664 aa, Homo sapiens
MPPRAPPAPGPRPPPRAAAATDTAAGAGGAGGAGGAGGPGFRPLAPRPWRWLLLLALPAACSAPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 937 - protein, 757 aa, Homo sapiens
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 938 - protein, 207 aa, Homo sapiens
MAAAWPSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRFYLGYPALGLLKFCTVGFCGIGSLIDFILISMQIVGPSDGSSYIIDYYGTRLTRLSITNETFRKTQLYP

SEQ ID NO: 939 - protein, 263 aa, Homo sapiens
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 940 - protein, 448 aa, Homo sapiens
MFDCMDVLSVSPGQILDFYTASPSSCMLQEKALKACFSGLTQTEWQHRHTAQSIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 941 - protein, 336 aa, Homo sapiens
MIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 942 - protein, 246 aa, Homo sapiens
MQPFLLLLAFLLTPGAGTEEIIGGHEAKPHSRPYMAFVQFLQEKSRKRCGGILVRKDFVLTAAHCQGSSINVTLGAHNIKEQERTQQFIPVKRPIPHPAYNPKNFSNDIMLLQLERKAKWTTAVRPLRLPSSKAQVKPGQLCSVAGWGYVSMSTLATTLQEVLLTVQKDCQCERLFHGNYSRATEICVGDPKKTQTGFKGDSGGPLVCKDVAQGILSYGNKKGTPPGVYIKVSHFLPWIKRTMKRL

SEQ ID NO: 943 - protein, 1121 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKCSVCKSVSDTYDPYLDVALEIRQAANIVRALELFVKADVLSGENAYMCAKCKKKVPASKRFTIHRTSNVLTLSLKRFANFSGGKITKDVGYPEFLNIRPYMSQNNGDPVMYGLYAVLVHSGYSCHAGHYYCYVKASNGQWYQMNDSLVHSSNVKVVLNQQAYVLFYLRIPGSKKSPEGLISRTGSSSLPGRPSVIPDHSKKNIGNGIISSPLTGKRQDSGTMKKPHTTEEIGVPISRNGSTLGLKSQNGCIPPKLPSGSPSPKLSQTPTHMPTILDDPGKKVKKPAPPQHFSPRTAQGLPGTSNSNSSRSGSQRQGSWDSRDVVLSTSPKLLATATANGHGLKGNDESAGLDRRGSSSSSPEHSASSDSTKAPQTPRSGAAHLCDSQETNCSTAGHSKTPPSGADSKTVKLKSPVLSNTTTEPASTMSPPPAKKLALSAKKASTLWRATGNDLRPPPPSPSSDLTHPMKTSHPVVASTWPVHRARAVSPAPQSSSRLQPPFSPHPTLLSSTPKPPGTSEPRSCSSISTALPQVNEDLVSLPHQLPEASEPPRSPSEKRKKTFVGEPQRLGSETCLPQHIREATAAPHGKRKRKKKKRPEDTAASALQEGQTQRQPGSPMYRREGQAQLPAVRRQEDGTQPQVNGQQVGCVTDGHHASSRKRRRKGAEGLGEEGGLHQDPLRHSCSPMGDGDPEAMEESPRKKKKRKQETQRAVEEDGHLKCPRSAKPQDAVVPESSSCAPSANGWCPGDRMGLSQAPPVSWNGERESDVVQELLKYSSDKAYGRKVLTWDGKMSAVSQDAIEDSRQARTETVVDDWDEEFDRGKEKKIKKFKREKRRNFNAFQKLQTRRNFWSVTHPAKAASLSYRR

SEQ ID NO: 944 - protein, 382 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 945 - protein, 574 aa, Homo sapiens
MKETIQGTGSWGPEPPGPGIPPAYSSPRRERLRWPPPPKPRLKSGGGFGPDPGSGTTVPARRLPVPRPSFDASASEEEEEEEEEEDEDEEEEVAAWRLPPRWSQLGTSQRPRPSRPTHRKTCSQRRRRAMRAFRMLLYSKSTSLTFHWKLWGRHRGRRRGLAHPKNHLSPQQGGATPQVPSPCCRFDSPRGPPPPRLGLLGALMAEDGVRGSPPVPSGPPMEEDGLRWTPKSPLDPDSGLLSCTLPNGFGGQSGPEGERSLAPPDASILISNVCSIGDHVAQELFQGSDLGMAEEAERPGEKAGQHSPLREEHVTCVQSILDEFLQTYGSLIPLSTDEVVEKLEDIFQQEFSTPSRKGLVLQLIQSYQRMPGNAMVRGFRVAYKRHVLTMDDLGTLYGQNWLNDQVMNMYGDLVMDTVPEKVHFFNSFFYDKLRTKGYDGVKRWTKNVDIFNKELLLIPIHLEVHWSLISVDVRRRTITYFDSQRTLNRRCPKHIAKYLQAEAVKKDRLDFHQGWKGYFKMNVARQNNDSDCGAFVLQYCKHLALSQPFSFTQQDMPKLRRQIYKELCHCKLTV

SEQ ID NO: 946 - protein, 640 aa, Homo sapiens
MDRCKHVGRLRLAQDHSILNPQKWCCLECATTESVWACLKCSHVACGRYIEDHALKHFEETGHPLAMEVRDLYVFCYLCKDYVLNDNPEGDLKLLRSSLLAVRGQKQDTPVRRGRTLRSMASGEDVVLPQRAPQGQPQMLTALWYRRQRLLARTLRLWFEKSSRGQAKLEQRRQEEALERKKEEARRRRREVKRRLLEELASTPPRKSARLLLHTPRDAGPAASRPAALPTSRRVPAATLKLRRQPAMAPGVTGLRNLGNTCYMNSILQVLSHLQKFRECFLNLDPSKTEHLFPKATNGKTQLSGKPTNSSATELSLRNDRAEACEREGFCWNGRASISRSLELIQNKEPSSKHISLCRELHTLFRVMWSGKWALVSPFAMLHSVWSLIPAFRGYDQQDAQEFLCELLHKVQQELESEGTTRRILIPFSQRKLTKQVLKVVNTIFHGQLLSQVTCISCNYKSNTIEPFWDLSLEFPERYHCIEKGFVPLNQTECLLTEMLAKFTETEALEGRIYACDQCNSKRRKSNPKPLVLSEARKQLMIYRLPQVLRLHLKRFRWSGRNHREKIGVHVVFDQVLTMEPYCCRDMLSSLDKETFAYDLSAVVMHHGKGFGSGHYTAYCYNTEGGACALLCGVGDTERG

SEQ ID NO: 947 - protein, 437 aa, Homo sapiens
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRCLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDEGASMHPCDDTYCGPFPESEPEVKAVANFLRKHRKHIRAYLSFHAYAQMLLYPYSYKYATIPNFRCVESAAYKAVNALQSVYGVRYRYGPASTTLYVSSGSSMDWAYKNGIPYAFAFELRDTGYFGFLLPEMLIKPTCTETMLAVKNITMHLLKKCP

SEQ ID NO: 948 - protein, 520 aa, Homo sapiens
MGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIASAMSLYNCLAALIHKIPYGQCTIACRGKNMEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 949 - protein, 387 aa, Homo sapiens [sequence omitted]

SEQ ID NO: 950 - protein, 706 aa, Homo sapiens
MAGIRVTKVDWQRSRNGAAHHTQEYPCPELVVRRGQSFSLTLELSRALDCEEILIFTVETGPRASEALHTKAVFQTSELERGEGWTAAREAQMEKTLTVSLASPPSAVIGRYLLSIRLSSHRKHSNRRLGEFVLLFNPWCAEDDVFLASEEERQEYVLSDSGIIFRGVEKHIRAQGWNYGQFEEDILNICLSILDRSPGHQNNPATDVSCRHNPIYVTRVISAMVNSNNDRGVVQGQWQGKYGGGTSPLHWRGSVAILQKWLKGRYKPVKYGQCWVFAGVLCTVLRCLGIATRVVSNFNSAHDTDQNLSVDKYVDSFGRTLEDLTEDSMWNFHVWNESWFARQDLGPSYNGWQVLDATPQEESEGVFRCGPASVTAIREGDVHLAHDGPFVFAEVNADYITWLWHEDESRERVYSNTKKIGRCISTKAVGSDSRVDITDLYKYPEGSRKERQVYSKAVNRLFGVEASGRRIWIRRAGGRCLWRDDLLEPATKPSIAGKFKVLEPPMLGHDLRLALCLANLTSRAQRVRVNLSGATILYTRKPVAEILHESHAVRLGPQEEKRIPITISYSKYKEDLTEDKKILLAAMCLVTKGEKLLVEKDITLEDFITIKVLGPAMVGVAVTVEVTVVNPLIERVKDCALMVEGSGLLQEQLSIDVPTLEPQERASVQFDITPSKSGPRQLQVDLVSPHFPDIKGFVIVHVATAK

SEQ ID NO: 951 - protein, 670 aa, Homo sapiens
MSMLFKIKIMFIFLTLLSFSYVAKALAGIFMKISTTQIERRFEISSSLVGLIDGSFEIGNLFVIVFVSYFGSKLHRPKLIGIGCFLMGTGSILMALPHFFMGYYRYSKETNIDPSENSTSNLPNCLINQMLSLNRTPSEIIERGCVKESGSHMWIYVFMGNMLRGIGETPIVPLGISYIDDFAKEGHSSLYLGTVNVMGMTGLVFAFMLGSLFAKMYVDIGYVDLSTIRITPKDSRWVGAWWLGFLVSGIVSIISSIPFFFLPLNPNKPQKERKVSLFLHVLKTNDKRNQIANLTNRRKYITKNVTGFFQSLKSILTNPLYVIFVIFTLLHMSSYIASLTYIIKMVEQQYGWSASKTNFLLGVLALPAVAIGMFSGGYIIKKFKLSLVGLAKLAFCSATVHLLSQVLYFFLICESKSVAGLTLTYDGNSPVRSHVDVPLSYCNSECNCDESQWEPVCGNNGITYLSPCLAGCKSSSGNKEPIVFYNCSCVEVIGLQNKNYSAHLGECPRDDACTRKSYVYFVIQVLDAFLCAVGLTSYSVLVIRIVQPELKALAIGFHSMIMRSLGGILVPIYFGALIDTTCMKWSTNSCGARGACRIYNSTYLGRAFFGLKVALIFPVLVLLTVFIFVVRKKSHGKDTKVLENERQVMDEANLEFLNDSEHFVPSAEEQ

SEQ ID NO: 952 - protein, 248 aa, Homo sapiens
MLALIIFNKEFDSLSKRVGAEVDVIGMMMLLQNLGYKVDEKRNLTASTKRFFGPPLFVMKLLKKSLSTYLLAFQGAMRVNHIVQNQQYGLFQEMTTELEVFSLHQEHKASGICGKKYSEQVPDVLQLNEIFKTLNSKNCPSLKDKPKVIIIQACHVENHGVVLVKDSVPASENISLPTPGDFEDDAINQVHIEKDFIAFCSSTLGNRFLVHRTSLWVQLSFEQPDDKAQMPSTERVTSTRRFYLFPVH

SEQ ID NO: 953 - protein, 801 aa, Homo sapiens [sequence omitted]

SEQ ID NO: 954 - protein, 426 aa, Homo sapiens [sequence omitted]

SEQ ID NO: 955 - protein, 559 aa, Homo sapiens; identical to SEQ ID NO: 898

SEQ ID NO: 956 - protein, 2432 aa, Homo sapiens
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKASAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 957 - protein, 2429 aa, Homo sapiens
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 958 - protein, 1092 aa, Homo sapiens
MMDSPKIGNGLPVIGPGTDIGISSLHMVGYLGKNFDSAKVPSDEYCPACREKGKLKALKTYRISFQESIFLCEDLQCIYPLGSKSLNNLISPDLEECHTPHKPQKRKSLESSYKDSLLLANSKKTRNYIAIDGGKVLNSKHNGEVYDETSSNLPDSSGQQNPIRTADSLERNEILEADTVDMATTKDPATVDVSGTGRPSPQNEGCTSKLEMPLESKCTSFPQALCVQWKNAYALCWLDCILSALVHSEELKNTVTGLCSKEESIFWRLLTKYNQANTLLYTSQLSGVKDGDCKKLTSEIFAEIETCLNEVRDEIFISLQPQLRCTLGDMESPVFAFPLLLKLETHIEKLFLYSFSWDFECSQCGHQYQNRHMKSLVTFTNVIPEWHPLNAAHFGPCNNCNSKSQIRKMVLEKVSPIFMLHFVEGLPQNDLQHYAFHFEGCLYQITSVIQYRANNHFITWILDADGSWLECDDLKGPCSERHKKFEVPASEIHIVIWERKISQVTDKEAACLPLKKTNDQHALSNEKPVSSTSCSVGDAASAETASVTHPKDISVAPRTLSQDTAVTHGDHLLSGPKGLVDNILPLTLEETIQKTASVSQLNSEAFLLENKPVAENTGILKTNTLLSQESLMASSVSAPCNEKLIQDQFVDISFPSQVVNTNMQSVQLNTEDTVNTKSVNNTDATGLIQGVKSVEIEKDAQLKQFLTPKTEQLKPERVTSQVSNLKKKETTADSQTTTSKSLQNQSLKENQKKPFVGSWVKGLISRGASFMPLCVSAHNRNTITDLQPSVKGVNNFGGFKTKGINQKASHVSKKARKSASKPPPISKPPAGPPSSNGTAAHPHAHAASEVLEKSGSTSCGAQLNHSSYGNGISSANHEDLVEGQIHKLRLKLRKKLKAEKKKLAALMSSPQSRTVRSENLEQVPQDGSPNDCESIEDLLNELPYPIDIANESACTTVPGVSLYSSQTHEEILAELLSPTPVSTELSENGEGDFRYLGMGDSHIPPPVPSEFNDVSQNTHLRQDHNYCSPTKKNPCEVQPDSLTNNACVRTLNLESPMKTDIFDEFFSSSALNALANDTLDLPHFDEYLFENY

SEQ ID NO: 959 - protein, 602 aa, Homo sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 960 - protein, 145 aa, Homo sapiens
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCK

SEQ ID NO: 961 - protein, 1048 aa, Homo sapiens
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNELKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 962 - protein, 2253 aa, Homo sapiens
MRPGPALLLLGVGLSLSVGRLPLPPVPRGAQAAVSGAPGGLLRGAPGLGVRGGRALLSLRPSAVRAGGAVLSGRGSLCFPHGGTGRRWYCLDLRVLLSAQRLPWPAAPALALVDLQLSARGGRLSLTWSVRLPRSPGRLAWAFRLRLLGPGAARPASPAARVSPRSAAPGPRPQQGFVARTECPTDGPARVMLQAVNSSSHRAVESSVSCQINACVIQRVRINTDQKGAPVRLSMQAEATINASVQLDCPAARAIAQYWQVFSVPAVGQAPDWTQPLDLPQLEIRNSPLFIHIPNNSLQWGVYVFNFTVSITTGNPKMPEVKDSDAVYVWIVRSSLQAVMLGDANITANFTEQLILDGSTSSDPDADSPLQGLQFFWYCTTDPRNYGGDRIILGSKEVCHPEQANLKWPWASGPVLTLLPETLKGDHVYFFRMVIRKDSRTAFSDKRVHVLQGPKAIAHITCIENCERNFIVSDRFSLFLNCTNCASRDFYKWSILSSSGGEMLFDWMGETVTGRNGAYLSIKAFAFRHFLEAEFSISLYLACWSGVTSVFRHSFIINHGPQIGECKINPAKGIALITKFVVQCSNFRDKHVPLTYKIIVSDLHSVGEISSVKENTLGTILYLGPQSTVPPSFLPVGMLASQYGLKIYAQVYDSLGAFSQVTLHATAQAPTDKNSSKTVLNQLLSFTVGPSSLLSTLIQKKDFLPAGYLLYIVASVLNNMKTELPLRDDRVNLRKHLIDQSFLLPVSTLVEIGQVVMTITKLTQKPSEFTWDAQKRATMRVWQANQALQEYQQKDKRFRSEQIEIVSTGILMSLSNILKMTSPHQVVKDPFYVIESLSDTILANKVPGNKTTSMRTPNFNMYVKKVEKWGINQLFRNEKHCRNCFYPTLNVSSVPGLSANGPISTMFCDFTNDLFPWLNDQENTSVEVSGFRMTGVADNGSVLEITPDVAEVYLVRKNLTFAAFNLTVGPNSEVDGSLKKTTGGFSFQVDSTVLREVLVHIVTEVMVLFTVLVYTGSQITPTALVATFLVPHDIPPFASQSALFDPACTVKKARVVCLPVSLLQLIAQHSHSPHCTVSIVLQAPRFVMKLNDKLVRISIFSVQCLDMYGIQSEWREGYCILGEKTSWYEVHCICKNVVRARRQLGTIGLTGIHLHTHYVMAKVIVIPNPVDLRLNIIKSLHQNPVTLFTVLFIILLYVGLAFWALYRDEMDQHLRGHVIVLPDNDPYDNLCYLVTIFTGSRWGSGTRANVFVQLRGTVSTSDVHCLSHPHFTTLYRGSINTFLLTTKSDLGDIHSIRVWHNNEGRSPSWYLSRIKVENLFSRHIWLFICQKWLSVDTTLDRTFHVTHPDERLTRKDFFFIDVSSNLRKNHMWFSIFASVVAKTFNRLQRLSCCLAMLLSSLLCNIMFFNLNRQEQTESRERKYMRSMMIGIESVLITIPVQLLITFLFTCSQRKPQADLKEVSPQKHPLMSEASEHWEEYLRKWHAYETAKVHPREVAKPASKGKPRLPKASPKATSKPKHRHRKAQIKTPETLGPNTNSNNNIEDDQDVHSEQHPSQKDLQQLKKKPRIVLPWWCVYVAWFLVFATSSISSFFIVFYGLTYGYDKSIEWLFASFCSFCQSVLLVQPSKIILLSGFRTNKPKYCKNLSWSTKYKYTEIRLDGMRMHPEEMQRIHDQIVRIRGTRMYQPLTEDEIRIFKRKKRIKRRALLFLSYILTHFIFLALLLILIVLLRHTDCFYYNQFIRDRFSMDLATVTKLEDIYRWLNSVLLPLLHNDLNPTFLPESSSKILGLPLMRQVRAKSSEKMCLPAEKFVQNSIRREIHCHPKYGIDPEDTKNYSGFWNEVDKQAIDESTNGFTYKPQGTQWLYYSYGLLHTYGSGGYALYFFPEQQRFNSTLRLKELQESNWLDEKTWAVVLELTTFNPDINLFCSISVIFEVSQLGVVNTSISLHSFSLADFDRKASAEIYLYVAILIFFLAYVVDEGCIIMQERASYVRSVYNLLNFALKCIFTVLIVLFLRKHFLATGIIRFYLSNPEDFIPFHAVSQVDHIMRIILGFLLFLTILKTLRYSRFFYDVRLAQRAIQAALPGICHMAFVVSVYFFVYMAFGYLVFGQHEWNYSNLIHSTQTVFSYCVSAFQNTEFSNNRILGVLFLSSFMLVMICVLINLFQAVILSAYEEMKQPVYEEPSDEVEAMTYLCRKLRTMFSFLTSQSKAKDEPEFFIDMLYGQPEKNSHRYLGLKTRNINGKKMVYLVV

SEQ ID NO: 963 - protein, 435 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRKFRMGLIQTADQLRFSYLAVIEGAKFIMGDSSVQDQWKELSHEDLEPPPEHIPPPPRPPKRILEPHNGKCREFFPNHQWVKEETQEDKDCPIKEEKGSPLNAAPYGIESMSQDTEVRSRVVGGSLRGAQAASPAKGEPSLPEKDEDHALSYWKPFLVNMCVATVLTAGAYLCYRFLFNSNT

SEQ ID NO: 964 - protein, 956 aa, Homo sapiens
MPRVSAPLVLLPAWLVMVACSPHSLRIAAILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECLLNLEKLLRQFLISKDTLSVRMLDDTRDPTPLLKEIRDDKTATIIIHANASMSHTILLKAAELGMVSAYYTYIFTNLEFSLQRMDSLVDDRVNILGFSIFNQSHAFFQEFAQSLNQSWQENCDHVPFTGPALSSALLFDAVYAVVTAVQELNRSQEIGVKPLSCGSAQIWQHGTSLMNYLRMVELEGLTGHIEFNSKGQRSNYALKILQFTRNGFRQIGQWHVAEGLSMDSHLYASNISDTLFNTTLVVTTILENPYLMLKGNHQEMEGNDRYEGFCVDMLKELAEILRFNYKIRLVGDGVYGVPEANGTWTGMVGELIARKADLAVAGLTITAEREKVIDFSKPFMTLGISILYRVHMGRKPGYFSFLDPFSPGVWLFMLLAYLAVSCVLFLVARLTPYEWYSPHPCAQGRCNLLVNQYSLGNSLWFPVGGFMQQGSTIAPRALSTRCVSGVWWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQIGGLLDTKGYGIGMPVGSVFRDEFDLAILQLQENNRLEILKRKWWEGGKCPKEEDHRAKGLGMENIGGIFVVLICGLIVAIFMAMLEFLWTLRHSEATEVSVCQEMVTELRSIILCQDSIHPRRRRAAVPPPRPPIPEERRPRGTATLSNGKLCGAGEPDQLAQRLAQEAALVARGCTHIRVCPECRRFQGLRARPSPARSEESLEWEKTTNSSEPE

SEQ ID NO: 965 - protein, 374 aa, Homo sapiens
MKRQNVRTLSLIVCTFTYLLVGAAVFDALESDHEMREEEKLKAEEIRIKGKYNISSEDYRQLELVILQSEPHRAGVQWKFAGSFYFAITVITTIGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 966 - protein, 2022 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGTVGKYGNEMKLRRNLEKYLSLQKIHCRSRQGVPVVGLVVEGGPNVILSVWETVKDKDPVVVCEGTGRAADLLAFTHKHLADEGMLRPQVKEEIICMIQNTFNFSLKQSKHLFQILMECMVHRDCITIFDADSEEQQDLDLAILTALLKGTNLSASEQLNLAMAWDRVDIAKKHILIYEQHWKPDALEQAMSDALVMDRVDFVKLLIEYGVNLHRFLTIPRLEELYNTKQGPTNTLLHHLVQDVKQHTLLSGYRITLIDIGLVVEYLIGRAYRSNYTRKHFRALYNNLYRKYKHQRHSSGNRNESAESTLHSQFIRTAQPYKFKEKSIVLHKSRKKSKEQNVSDDPESTGFLYPYNDLLVWAVLMKRQKMAMFFWQHGEEATVKAVIACILYRAMAHEAKESHMVDDASEELKNYSKQFGQLALDLLEKAFKQNERMAMTLLTYELRNWSNSTCLKLAVSGGLRPFVSHTCTQMLLTDMWMGRLKMRKNSWLKIIISIILPPTILTLEFKSKAEMSHVPQSQDFQFMWYYSDQNASSSKESASVKEYDLERGHDEKLDENQHFGLESGHQHLPWTRKVYEFYSAPIVKFWFYTMAYLAFLMLFTYTVLVEMQPQPSVQEWLVSIYIFTNAIEVVREICISEPGKFTQKVKVWISEYWNLTETVAIGLFSAGFVLRWGDPPFHTAGRLIYCIDIIFWFSRLLDFFAVNQHAGPYVTMIAKMTANMFYIVIIMAIVLLSFGVARKAILSPKEPPSWSLARDIVFEPYWMIYGEVYAGEIDVCSSQPSCPPGSFLTPFLQAVYLFVQYIIMVNLLIAFFNNVYLDMESISNNLWKYNRYRYIMTYHEKPWLPPPLILLSHVGLLLRRLCCHRAPHDQEEGDVGLKLYLSKEDLKKLHDFEEQCVEKYFHEKMEDVNCSCEERIRVTSERVTEMYFQLKEMNEKVSFIKDSLLSLDSQVGHLQDLSALTVDTLKVLSAVDTLQEDEALLAKRKHSTCKKLPHSWSNVICAEVLGSMEIAGEKKYQYYSMPSSLLRSLAGGRHPPRVQRGALLEITNSKREATNVRNDQERQETQSSIVVSGVSPNRQAHSKYGQFLLVPSNLKRVPFSAETVLPLSRPSVPDVLATEQDIQTEVLVHLTGQTPVVSDWASVDEPKEKHEPIAHLLDGQDKAEQVLPTLSCTPEPMTMSSPLSQAKIMQTGGGYVNWAFSEGDETGVFSIKKKWQTCLPSTCDSDSSRSEQHQKQAQDSSLSDNSTRSAQSSECSEVGPWLQPNTSFWINPLRRYRPFARSHSFRFHKEEKLMKICKIKNLSGSSEIGQGAWVKAKMLTKDRRLSKKKKNTQGLQVPIITVNACSQSDQLNPEPGENSISEEEYSKNWFTVSKFSHTGVEPYIHQKMKTKEIGQCAIQISDYLKQSQEDLSKNSLWNSRSTNLNRNSLLKSSIGVDKISASLKSPQEPHHHYSAIERNNLMRLSQTIPFTPVQLFAGEEITVYRLEESSPLNLDKSMSSWSQRGRAAMIQVLSREEMDGGLRKAMRVVSTWSEDDILKPGQVFIVKSFLPEVVRTWHKIFQESTVLHLCLREIQQQRAAQKLIYTFNQVKPQTIPYTPRFLEVFLIYCHSANQWLTIEKYMTGEFRKYNNNNGDEITPTNTLEELMLAFSHWTYEYTRGELLVLDLQGVGENLTDPSVIKPEVKQSRGMVFGPANLGEDAIRNFIAKHHCNSCCRKLKLPDLKRNDYSPERINSTFGLEIKIESAEEPPARETGRNSPEDDMQL

SEQ ID NO: 967 - protein, 2644 aa, Homo sapiens
MGEHGLELASMIPALRELGSATPEEYNTVVQKPRQILCQFIDRILTDVNVVAVELVKKTDSQPTSVMLLDFIQHIMKSSPLMFVNVSGSHERKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 968 - protein, 822 aa, Homo sapiens
MKGDYVLGGLFPLGEAEEAGLRSRTRPSSPVCTRFSSNGLLWALAMKMAVEEINNKSDLLPGLRLGYDLFDTCSEPVVAMKPSLMFLAKAGSRDIAAYCNYTQYQPRVLAVIGPHSSELAMVTGKFFSFFLMPQVSYGASMELLSARETFPSFFRTVPSDRVQLTAAAELLQEFGWNWVAALGSDDEYGRQGLSIFSALAAARGICIAHEGLVPLPRADDSRLGKVQDVLHQVNQSSVQVVLLFASVHAAHALFNYSISSRLSPKVWVASEAWLTSDLVMGLPGMAQMGTVLGFLQRGAQLHEFPQYVKTHLALATDPAFCSALGEREQGLEEDVVGQRCPQCDCITLQNVSAGLNHHQTFSVYAAVYSVAQALHNTLQCNASGCPAQDPVKPWQLLENMYNLTFHVGGLPLRFDSSGNVDMEYDLKLWVWQGSVPRLHDVGRFNGSLRTERLKIRWHTSDNQKPVSRCSRQCQEGQVRRVKGFHSCCYDCVDCEAGSYRQNPDDIACTFCGQDEWSPERSTRCFRRRSRFLAWGEPAVLLLLLLLSLALGLVLAALGLFVHHRDSPLVQASGGPLACFGLVCLGLVCLSVLLFPGQPSPARCLAQQPLSHLPLTGCLSTLFLQAAEIFVESELPLSWADRLSGCLRGPWAWLVVLLAMLVEVALCTWYLVAFPPEVVTDWHMLPTEALVHCRTRSWVSFGLAHATNATLAFLCFLGTFLVRSQPGCYNRARGLTFAMLAYFITWVSFVPLLANVQVVLRPAVQMGALLLCVLGILAAFHLPRCYLLMRQPGLNTPEFFLGGGPGDAQGQNDGNTGNQGKHE

SEQ ID NO: 969 - protein, 254 aa, Homo sapiens
MISVVLELALGFALAPGSSTLSSSLCRDKPLRPVILSPTMEEGHGLDLTYITERIIAVSFPAGCSEESYLHNLQEVTRMLKSKHGDNYLVLNLSEKRYDLTKLNPKIMDVGWPELHAPPLDKMCTICKAQESWLNSNLQHVVVIHCRGGKGRIGVVISSYMHFTNVSASADQALDRFAMKKFYDDKVSALMQPSQKRYVQFLSGLLSGSVKMNASPLFLHFVILHGTPNFDTGGVCRPFLKLYQAMQPVYTSGI

SEQ ID NO: 970 - protein, 349 aa, Homo sapiens
MEAHNASAPFNFTLPPNFGKRPTDLALSVILVFMLFFIMLSLGCTMEFSKIKAHLWKPKGLAIALVAQYGIMPLTAFVLGKVFRLKNIEALAILVCGCSPGGNLSNVFSLAMKGDMNLSIVMTTCSTFCALGMMPLLLYIYSRGIYDGDLKDKVPYKGIVISLVLVLIPCTIGIVLKSKRPQYMRYVIKGGMIIILLCSVAVTVLSAINVGKSIMFAMTPLLIATSSLMPFIGFLLGYVLSALFCLNGRCRRTVSMETGCQNVQLCSTILNVAFPPEVIGPLFFFPLLYMIFQLGEGLLLIAIFWCYEKFKTPKDKTKMIYTAATTEETIPGALGNGTYKGEDCSPCTA

SEQ ID NO: 971 - protein, 551 aa, Homo sapiens
MAQFVQVLAEIGDFGRFQIQLLILLCVLNFLSPFYFFAHVFMVLDEPHHCAVAWVKNHTFNLSAAEQLVLSVPLDTAGHPEPCLMFRPPPANASLQDILSHRFNETQPCDMGWEYPENRLPSLKNEFNLVCDRKHLKDTTQSVFMGGLLVGTLMFGPLCDRIGRKATILAQLLLFTLIGLATAFVPSFELYMALRFAVATAVAGLSFSNVTLLTEWVGPSWRTQAVVLAQCNFSLGQMVLAGLAYGFRNWRLLQITGTAPGLLLFFYFWALPESARWLLTRGRMDEAIQLIQKAASVNRRKLSPELMNQLVPEKTGPSGNALDLFRHPQLRKVTLIIFCVWFVDSLGYYGLSLQVGDFGLDVYLTQLIFGAVEVPARCSSIFMMQRFGRKWSQLGTLVLGGLMCIIIIFIPADLPVVVTMLAVVGKMATAAAFTISYVYSAELFPTILRQTGMGLVGIFSRIGGILTPLVILLGEYHAALPMLIYGSLPIVAGLLCTLLPETHGQGLKDTLQDLELGPHPRSPKSVPSEKETEAKGRTSSPGVAFVSSTYF

SEQ ID NO: 972 - protein, 134 aa, Homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 973 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 974 - protein, 468 aa, Homo sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAKEKIQDLLVDSGKFIYLEDGTGSAVSLE

SEQ ID NO: 975 - protein, 247 aa, Homo sapiens
MAAAIASGLIRQKRQAREQHWDRPSASRRRSSPSKNRGLCNGNLVDIFSKVRIFGLKKRRLRRQDPQLKGIVTRLYCRQGYYLQMHPDGALDGTKDDSTNSTLFNLIPVGLRVVAIQGVKTGLYIAMNGEGYLYPSELFTPECKFKESVFENYYVIYSSMLYRQQESGRAWFLGLNKEGQAMKGNRVKKTKPAAHFLPKPLEVAMYREPSLHDVGETVPKPGVTPSKSTSASAIMNGGKPVNKSKTT

SEQ ID NO: 976 - protein, 184 aa, Homo sapiens
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRIILEAEKMDGAASQGKSSCSVM

SEQ ID NO: 977 - protein, 597 aa, Homo sapiens
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQGAYFYLAGNAKSMPADVSEALMSIFQEEGGLCSPDAAAYLARLQQTRRFQTETWA

SEQ ID NO: 978 - protein, 164 aa, Homo sapiens
MNPQREAAPKSYAIRDSRQMVWVLSGNSLIAAPLSRSIKPVTLHLIACRDTEFSDKEKGNMVYLGIKGKDLCLFCAEIQGKPTLQLKLQGSQDNIGKDTCWKLVGIHTCINLDVRESCFMGTLDQWGIGVGRKKWKSSFQHHHLRKKDKDFSSMRTNIGMPGRM

SEQ ID NO: 979 - protein, 164 aa, Homo sapiens; identical to SEQ ID NO: 978

SEQ ID NO: 980 - protein, 326 aa, Homo sapiens
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQISKVFLMEKDQVEEVTYDVAQYIKFEMPVLKSFIQKLQEEEDREVKKLMRKYTVLRLMIRQRLEEIAETPATI

SEQ ID NO: 981 - protein, 326 aa, Homo sapiens; identical to SEQ ID NO: 980

SEQ ID NO: 982 - protein, 318 aa, Homo sapiens
MVELMFPLLLLLLPFLLYMAAPQIRKMLSSGVCTSTVQLPGKVVVVTGANTGIGKETAKELAQRGARVYLACRDVEKGELVAKEIQTTTGNQQVLVRKLDLSDTKSIRAFAKGFLAEEKHLHVLINNAGVMMCPYSKTADGFEMHIGVNHLGHFLLTHLLLEKLKESAPSRIVNVSSLAHHLGRIHFHNLQGEKFYNAGLAYCHSKLANILFTQELARRLKGSGVTTYSVHPGTVQSELVRHSSFMRWMWWLFSFFIKTPQQGAQTSLHCALTEGLEILSGNHFSDCHVAWVSVQARNETIARRLWDVSCDLLGLPID

SEQ ID NO: 983 - protein, 166 aa, Homo sapiens
MAAIPPDSWQPPNVYLETSMGIIVLELYWKHAPKTCKNFAELARRGYYNGTKFHRIIKDFMIQGGDPTGTGRGGASIYGKQFEDELHPDLKFTGAGILAMANAGPDTNGSQFFVTLAPTQWLDGKHTIFGRVCQGIGMVNRVGMVETNSQDRPVDDVKIIKAYPSG

SEQ ID NO: 984 - protein, 244 aa, Homo sapiens
MELFLAGRRVLVTGAGKGIGRGTVQALHATGARVVAVSRTQADLDSLVRECPGIEPVCVDLGDWEATERALGSVGPVDLLVNNAAVALLQPFLEVTKEAFDRSFEVNLRAVIQVSQIVARGLIARGVPGAIVNVSSQCSQRAVTNHSVYCSTKGALDMLTKVMALELGPHKIRVNAVNPTVVMTSMGQATWSDPHKAKTMLNRIPLGKFAEVEHVVNAILFLLSDRSGMTTGSTLPVEGGFWAC

SEQ ID NO: 985 - protein, 215 aa, Homo sapiens
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 986 - protein, 569 aa, Homo sapiens
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 987 - protein, 673 aa, Homo sapiens
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAELRLRQCADTRVGNMYVRGLSGGERRRVSIGVQLLWNPGILILDEPTSGLDSFTAHNLVKTLSRLAKGNRLVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGAEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMALAAAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 988 - protein, 342 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQVNGIVILADYKGVSLSKASHFGPFIAKKVIGILQDGFPIRIKAVHVVNEPRIFKGIFAIIKPFLKEKIANRFFLHGSDLNSLHTNLPRSILPKEYGGTAGELDTATWNAVLLASEDDFVKEFCQPVPACDSILGQTLLPEGLTSDAQCDDSLRAVKSQLYSCY

SEQ ID NO: 989 - protein, 577 aa, Homo sapiens
MGSRHFEGIYDHVGHFGRFQRVLYFICAFQNISCGIHYLASVFMGVTPHHVCRPPGNVSQVVFHNHSNWSLEDTGALLSSGQKDYVTVQLQNGEIWELSRCSRNKRENTSSLGYEYTGSKKEFPCVDGYIYDQNTWKSTAVTQWNLVCDRKWLAMLIQPLFMFGVLLGSVTFGYFSDRLGRRVVLWATSSSMFLFGIAAAFAVDYYTFMAARFFLAMVASGYLVVGFVYVMEFIGMKSRTWASVHLHSFFAVGTLLVALTGYLVRTWWLYQMILSTVTVPFILCCWVLPETPFWLLSEGRYEEAQKIVDIMAKWNRASSCKLSELLSLDLQGPVSNSPTEVQKHNLSYLFYNWSITKRTLTVWLIWFTGSLGFYSFSLNSVNLGGNEYLNLFLLGVVEIPAYTFVCIAMDKVGRRTVLAYSLFCSALACGVVMVIPQKHYILGVVTAMVGKFAIGAAFGLIYLYTAELYPTIVRSLAVGSGSMVCRLASILAPFSVDLSSIWIFIPQLFVGTMALLSGVLTLKLPETLGKRLATTWEEAAKLESENESKSSKLLLTTNNSGLEKTEAITPRDSGLGE

SEQ ID NO: 990 - protein, 970 aa, Homo sapiens
MAQLERSAISGFSSKSRRNSFAYDVKREVYNEETFQQEHKRKASSSGNMNINITTFRHHVQCRCSWHRFLRCVLTIFPFLEWMCMYRLKDWLLGDLLAGISVGLVQVPQGLTLSLLARQLIPPLNIAYAAFCSSVIYVIFGSCHQMSIGSFFLVSALLINVLKVSPFNNGQLVMGSFVKNEFSAPSYLMGYNKSLSVVATTTFLTGIIQLIMGVLGLGFIATYLPESAMSAYLAAVALHIMLSQLTFIFGIMISFHAGPISFFYDIINYCVALPKANSTSILVFLTVVVALRINKCIRISFNQYPIEFPMELFLIIGFTVIANKISMATETSQTLIDMIPYSFLLPVTPDFSLLPKIILQAFSLSLVSSFLLIFLGKKIASLHNYSVNSNQDLIAIGLCNVVSSFFRSCVFTGAIARTIIQDKSGGRQQFASLVGAGVMLLLMVKMGHFFYTLPNAVLAGIILSNVIPYLETISNLPSLWRQDQYDCALWMMTFSSSIFLGLDIGLIISVVSAFFITTVRSHRAKILLLGQIPNTNIYRSINDYREIITIPGVKIFQCCSSITFVNVYYLKHKLLKEVDMVKVPLKEEEIFSLFNSSDTNLQGGKICRCFCNCDDLEPLPRILYTERFENKLDPEASSINLIHCSHFESMNTSQTASEDQVPYTVSSVSQKNQGQQYEEVEEVWLPNNSSRNSSPGLPDVAESQGRRSLIPYSDASLLPSVHTIILDFSMVHYVDSRGLVVLRQICNAFQNANILILIAGCHSSIVRAFERNDFFDAGITKTQLFLSVHDAVLFALSRKVIGSSELSIDESETVIRETYSETDKNDNSRYKMSSSFLGSQKNVSPGFIKIQQPVEEESELDLELESEQEAGLGLDLDLDRELEPEMEPKAETETKTQTEMEPQPETEPEMEPNPKSRPRAHTFPQQRYWPMYHPSMASTQSQTQTRTWSVERRRHPMDSYSPEGNSNEDV

SEQ ID NO: 991 - protein, 533 aa, Homo sapiens
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 992 - protein, 888 aa, Homo sapiens [sequence omitted]

SEQ ID NO: 993 - protein, 266 aa, Homo sapiens [sequence omitted]

SEQ ID NO: 994 - protein, 1252 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQEHWAQDLNKVRERMTKFIDDTMRETAEPFLFVDEFLTYLFSRENSIWDEKYDAVDMQDMNNPLSHYWISSSHNTYLTGDQLRSESSPEAYIRCLRMGCRCIELDCWDGPDGKPVIYHGWTRTTKIKFDDVVQAIKDHAFVTSSFPVILSIEEHCSVEQQRHMAKAFKEVFGDLLLTKPTEASADQLPSPSQLREKIIIKHKKLGPRGDVDVNMEDKKDEHKQQGELYMWDSIDQKWTRHYCAIADAKLSFSDDIEQTMEEEVPQDIPPTELHFGEKWFHKKVEKRTSAEKLLQEYCMETGGKDGTFLVRESETFPNDYTLSFWRSGRVQHCRIRSTMEGGTLKYYLTDNLRFRRMYALIQHYRETHLPCAEFELRLTDPVPNPNPHESKPWYYDSLSRGEAEDMLMRIPRDGAFLIRKREGSDSYAITFRARGKVKHCRINRDGRHFVLGTSAYFESLVELVSYYEKHSLYRKMRLRYPVTPELLERYNTERDINSLYDVSRMYVDPSEINPSMPQRTVKALYDYKAKRSDELSFCRGALIHNVSKEPGGWWKGDYGTRIQQYFPSNYVEDISTADFEELEKQIIEDNPLGSLCRGILDLNTYNVVKAPQGKNQKSFVFILEPKEQGDPPVEFATDRVEELFEWFQSIREITWKIDSKENNMKYWEKNQSIAIELSDLVVYCKPTSKTKDNLENPDFREIRSFVETKADSIIRQKPVDLLKYNQKGLTRVYPKGQRVDSSNYDPFRLWLCGSQMVALNFQTADKYMQMNHALFSLNGRTGYVLQPESMRTEKYDPMPPESQRKILMTLTVKVLGARHLPKLGRSIACPFVEVEICGAEYGNNKFKTTVVNDNGLSPIWAPTQEKVTFEIYDPNLAFLRFVVYEEDMFSDPNFLAHATYPIKAVKSGFRSVPLKNGYSEDIELASLLVFCEMRPVLESEEELYSSCRQLRRRQEELNNQLFLYDTHQNLRNANRDALVKEFSVNENHSSCTRRNATRG

SEQ ID NO: 995 - protein, 499 aa, Homo sapiens
  MISC_FEATURE (498)..(498): X is a X is a selenocysteine residue
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEVFTTLSVTKRSGASILQAGCXG

SEQ ID NO: 996 - protein, 497 aa, Homo sapiens [sequence omitted]

SEQ ID NO: 997 - protein, 499 aa, Homo sapiens; identical to SEQ ID NO: 995
  MISC_FEATURE (498)..(498): X is a X is a selenocysteine residue

SEQ ID NO: 998 - protein, 499 aa, Homo sapiens; identical to SEQ ID NO: 995
  MISC_FEATURE (498)..(498): X is a X is a selenocysteine residue

SEQ ID NO: 999 - protein, 388 aa, Homo sapiens
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHFATKLDKYMYLLPYTEFFGGVSGLTVEQFRKINGFPNAFWGWGGEDDDLWNRVQNAGYSVSRPEGDTGKYKSIPHHHRGEVQFLGRYALLRKSKERQGLDGLNNLNYFANITYDALYKNITVNLTPELAQVNEY

SEQ ID NO: 1000 - protein, 383 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTSDMGGYATCHDFTEAVIAALPHP

SEQ ID NO: 1001 - protein, 385 aa, Homo sapiens
MAALSGVRWLTRALVSAGNPGAWRGLSTSAAAHAASRSQAEDVRVEGSFPVTMLPGDGVGPELMHAVKEVFKAAAVPVEFQEHHLSEVQNMASEEKLEQVLSSMKENKVAIIGKIHTPMEYKGELASYDMRLRRKLDLFANVVHVKSLPGYMTRHNNLDLVIIREQTEGEYSSLEHESARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 1002 - protein, 233 aa, Homo sapiens
MKMGERWSSLFPFPVSPSCCFLLTQSARGVIECLKIVTRAKSQRIAKFAFDYATKKGRGKVTAVHKANIMKLGDGLFLQCCEEVAELYPKIKFETMIIDNCCMQLVQNPYQFDVLVMPNLYGNIIDNLAAGLVGGAGVVPGESYSAEYAVFETGARHPFAQAVGRNIANPTAMLLSASNMLRHLNLEYHSSMIADAVKKVIKVGKVRTRDMGGYSTTTDFIKSVIGHLQTKGS

SEQ ID NO: 1003 - protein, 350 aa, Homo sapiens
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQIYNPAFFKYIHDRWTEHHGRYPSTGMLVLFFALHVCDEVNVYGFGADSRGNWHHYWENNRYAGEFRKTGVHDADFEAHIIDMLAKASKIEVYRGN

SEQ ID NO: 1004 - protein, 326 aa, Homo sapiens
MASKVSCLYVLTVVCWASALWYLSITRPTSSYTGSKPFSHLTVARKNFTFGNIRTRPINPHSFEFLINEPNKCEKNIPFLVILISTTHKEFDARQAIRETWGDENNFKGIKIATLFLLGKNADPVLNQMVEQESQIFHDIIVEDFIDSYHNLTLKTLMGMRWVATFCSKAKYVMKTDSDIFVNMDNLIYKLLKPSTKPRRRYFTGYVINGGPIRDVRSKWYMPRDLYPDSNYPPFCSGTGYIFSADVAELIYKTSLHTRLLHLEDVYVGLCLRKLGIHPFQNSGFNHWKMAYSLCRYRRVITVHQISPEEMHRIWNDMSSKKHLRC

SEQ ID NO: 1005 - protein, 278 aa, Homo sapiens
MHKAGLLGLCARAWNSVRMASSGMTRRDPLANKVALVTASTDGIGFAIARRLAQDGAHVVVSSRKQQNVDQAVATLQGEGLSVTGTVCHVGKAEDRERLVATAVKLHGGIDILVSNAAVNPFFGSIMDVTEEVWDKTLDINVKAPALMTKAVVPEMEKRGGGSVVIVSSIAAFSPSPGFSPYNVSKTALLGLTKTLAIELAPRNIRVNCLAPGLIKTSFSRMLWMDKEKEESMKETLRIRRLGEPEDCAGIVSFLCSEDASYITGETVVVGGGTPSRL

SEQ ID NO: 1006 - protein, 230 aa, Homo sapiens
MARLLGLCAWARKSVRLASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKTLDINVKAPALMTKAVVPEMEKRGGGSVVIVSSIAAFSPSPGFSPYNVSKTALLGLNNTLAIELAPRNIRVNCLHLDLSRLASAGCSGWTRKKRKA

SEQ ID NO: 1007 - protein, 160 aa, Homo sapiens
MVNPTVFFDTEPLGRISFELFADKFPKTAGNFHALSTGEKGFGYKGSCFHRIVPGFMCQGGDFTCHDGTGGKSIYREKFDDKNFIRKHTVSGILSMANAGPNANSSQFFICAAKTEWLDGKHVVFSKVKEGMNIVETMECFGSRNGKTSKKITIADCGQL

SEQ ID NO: 1008 - protein, 159 aa, Homo sapiens
  misc_feature (157)..(157): Xaa can be any naturally occurring amino acid
MVNPTKFFNEPWGRISIQLFADKFPKTAENVCALSIGEKGFGYKGSCFHRIIPGFMCHGGDFTHHNGSGGKYIYGEKFDDENFILKQTGSGILSKENAGPNTNGSQFFICSAKSEWLDGEHVFFGKVKEGMNIVEAMEGFGSRNGKTSKKITIADCXQL

SEQ ID NO: 1009 - protein, 165 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 1010 - protein, 105 aa, Homo sapiens
MCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 1011 - protein, 615 aa, Homo sapiens
  misc_feature (514)..(514): Xaa can be any naturally occurring amino acid
  misc_feature (594)..(594): Xaa can be any naturally occurring amino acid
MDSTQAVQTPAEPGLHLGQTDCVDSCEAVMPSLELAVSKYTLGTCGNQCPSVCQKKVSICHMAPAEEGRKRDAESWGRPRRWRPACGLAHRSVSTMVGRGGKSSNQGYRIALRTEATRLEGKKFYSLTAAITFLLNGHECPFVCLMAHACAPLIYMALEDHSSIPRTKSHYSVFFLSVCREEDEHEDPGGTRSIQPLLLRRSLRVETGKLIERKSSIRVPDKIENEKPLLCGPSRPGSIQSKQRTAVSRARVFGIHLSLCSVNACSVQMSFESKSLDLLETRCSPLGDDNSGWWFLLSGLRGAFPGVGCLSQDLKEGKCTQILTARVQVLKQEVCSGAPSGLAKLPVHSGPAEEMESCTLSGRKMQTIPTDAWTPLSMATSRTTPSLQGPVMFALKIKSKYYFPEKELNLPGEERSYKSRGLSERPEQSLSNTSSPAFVDAAATRSPVLSATVNPTVFFNIAIDSEPLGHVSFKLFADKFPKTAENFCALSTGEKAFGYKGSCFHRIIPGFMYXGGDFTHHNSTGGKSIYGEKFDDENFILKHTGHGILSMANAGPSTNGSQFFICTAKSEWLDGKQVVFGKMKEGMNIVEATXRFGSRNGKTSKKITIADYGHL

SEQ ID NO: 1012 - protein, 95 aa, Homo sapiens [sequence omitted]

SEQ ID NO: 1013 - protein, 95 aa, Homo sapiens [sequence omitted]

SEQ ID NO: 1014 - protein, 105 aa, Homo sapiens [sequence omitted]

SEQ ID NO: 1015 - protein, 105 aa, Homo sapiens; identical to SEQ ID NO: 1010

SEQ ID NO: 1016 - protein, 336 aa, Homo sapiens
MGWESYNRRRHPSKENDLEQGAQRLRKTLLLVPCGRLTDQRLQFTIHPPTFRLQHRRGSRSLPLGTLMSLYRPREGQRGSAKAPFLACQPIAPRNRASISFCLPQYFIRGFAPGPLEAPGPWSQGNPLVLSSVAHGGPEPAKPAPGSGNQALNKKTAGPKEDTATAGSPVLSAMVNPTVFIDGESLGHVSFKLSADKFPKTAENFRAMSTGEKGFGYKGSCFHRIIPGFMCRGGDFTHHNGTGGKSVHQEKFDDENFILKHTGPGILSTANAGPNTNCSWFFISIAKTESLDGQHVVFGNMKEGMNVVEAMEPFGFRNGKTSKKITIADCGQLQQI

SEQ ID NO: 1017 - protein, 164 aa, Homo sapiens
MVNSVVFFDITVDGKPLGRISIKLFADKILKTAENFRALSTGEKGFRYKGSCFHRIIPGFMCQGGDFTRHNGTGDKSIYGEKFDDENLIRKHTGSGILSMANAGPNTNGSQFFICAAKTEWLDGKHVAFGKVKERVNIVEAMEHFGYRNSKTSKKITIADCGQF

SEQ ID NO: 1018 - protein, 255 aa, Homo sapiens [sequence omitted]

SEQ ID NO: 1019 - protein, 255 aa, Homo sapiens [sequence omitted]

SEQ ID NO: 1020 - protein, 164 aa, Homo sapiens
MVNSVVFFEITRDGKPLGRISIKLFADKIPKTAENFRALSTGEKGFRYKGSCFHRIIPGFMCQGGDFTRPNGTGDKSIYGEKFDDENLIRKHTGSGILSMANAGPNTNGSQFFICAAKTEWLDGKHVAFGKVKERVNIVEATEHFGYRNSKTSKKITIADCGQF

SEQ ID NO: 1021 - protein, 164 aa, Homo sapiens; identical to SEQ ID NO: 1020

SEQ ID NO: 1022 - protein, 163 aa, Homo sapiens [sequence omitted]

SEQ ID NO: 1023 - protein, 164 aa, Homo sapiens
MAKIQDLKKHLEDTLNKIKNADASQSPLPPAIVNPIMFFNIAIISELLSRISLELIIPGFMCQAGDFTNHNGTGSKSLYGEKFDHENFILKHTGPGILSMANVGLNTNSSQFFICTAKTEWLDGKHVVFGKVKEGMSIMEAMERFGSRNGKTSKKITIADCGQL

SEQ ID NO: 1024 - protein, 165 aa, Homo sapiens; identical to SEQ ID NO: 1009

SEQ ID NO: 1025 - protein, 159 aa, Homo sapiens; identical to SEQ ID NO: 1008
  misc_feature (157)..(157): Xaa can be any naturally occurring amino acid

SEQ ID NO: 1026 - protein, 165 aa, Homo sapiens; identical to SEQ ID NO: 1009

SEQ ID NO: 1027 - protein, 105 aa, Homo sapiens; identical to SEQ ID NO: 1010

SEQ ID NO: 1028 - protein, 615 aa, Homo sapiens; identical to SEQ ID NO: 1011
  misc_feature (514)..(514): Xaa can be any naturally occurring amino acid
  misc_feature (594)..(594): Xaa can be any naturally occurring amino acid

SEQ ID NO: 1029 - protein, 247 aa, Homo sapiens
MRKWVGGLPCPHVAVTSAEGCRKELNAEPRRLLQPSDLTPLTRWSLSAIKPDLELTVAAVYPLVGLYCEARQKSGPSAPSPGKAAKLQQTELNWYFPPVLGPHLFQAVCRQISKNNENFHALSTVEKGFGYKGSCFHRIISEFMCQGGDFPCHNGTDGKFIYGEKFDDENFILKHTGPGILSIANARPNSNGSQFFICTAKTEWLDGKHVVFGKVKEGMNIVEAMDRSGSRNGKTNKKIIIADCGQL

SEQ ID NO: 1030 - protein, 105 aa, Homo sapiens; identical to SEQ ID NO: 1010

SEQ ID NO: 1031 - protein, 255 aa, Homo sapiens [sequence omitted]

SEQ ID NO: 1032 - protein, 272 aa, Homo sapiens
MVNPTVFFDISVSGKPLGHVSFRIFADKLSKTAQNFRALSTGEKGLDYKGSCFHRIIPGFMCQGGDFTYNNGTGGKSLYGEKFDDENFILKRIRPGILSMAKAGPNTNGSQFFICTAKTEWLIGKHVVFGKVKEGMNIVEAMEPFGSRNGKTSKKITIADCGQLWILADPSIDDLLLLAVSRVASLKPPEQRPGIFSEQQPTRQLEETPGLFCSQASLLSSSGHFSPPPSLLTLSAITPKEGRFLECPACHPRDSPQGTHCWIQQVCPSASP

SEQ ID NO: 1033 - protein, 163 aa, Homo sapiens [sequence omitted]

SEQ ID NO: 1034 - protein, 165 aa, Homo sapiens; identical to SEQ ID NO: 1009

SEQ ID NO: 1035 - protein, 517 aa, Homo sapiens
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 1036 - protein, 349 aa, Homo sapiens
MALLRKINQVLLFLLIVTLCVILYKKVHKGTVPKNDADDESETPEELEEEIPVVICAAAGRMGATMAAINSIYSNTDANILFYVVGLRNTLTRIRKWIEHSKLREINFKIVEFNPMVLKGKIRPDSSRPELLQPLNFVRFYLPLLIHQHEKVIYLDDDVIVQGDIQELYDTTLALGHAAAFSDDCDLPSAQDINRLVGLQNTYMGYLDYRKKAIKDLGISPSTCSFNPGVIVANMTEWKHQRITKQLEKWMQKNVEENLYSSSLGGGVATSPMLIVFHGKYSTINPLWHIRHLGWNPDARYSEHFLQEAKLLHWNGRHKPWDFPSVHNDLWESWFVPDPAGIFKLNHHS

SEQ ID NO: 1037 - protein, 669 aa, Homo sapiens
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 1038 - protein, 251 aa, Homo sapiens
MGGSTSQQRKGRSCQIAMEGGVRLRPPVPRGMRMLGEHLWRHGKCASFNGISGRAALDVGFHCTSKAENRKFFTNDNPITIFQEKDSTKIKYNDIRHRLCCGVKGNLHWHGDIWGSHRWKQVLRPQVKVIHDKCSIMEKIMTTVLYITATQNTMNGPSAISLSVTGLTWHQDKPAKYDSIKKTVKQALDKTFKGILGFTEEQVVSSDFNAKFLVNNKFDYSNKVVNLIVHIGLHELKSPVTTGSREHKRKR

SEQ ID NO: 1039 - protein, 375 aa, Homo sapiens [sequence omitted]

SEQ ID NO: 1040 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 1041 - protein, 504 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKLVLVKECYSVFTNREPFGPVGFMKSAISIAEDEEWKRLRSLLSPTFTSGKLKEMVPIIAQYGDVLVRNLRRERETGKPVTLKDVFGAYSMDVITSSSFGVNVDSLNNPQDPLVENTKKLLRFDFLDPFFLSITVFPFLIPILEVLNICVFPREVTNFLRKAVKRMKESRLEDTQKHRVDFLQLMIDSHKNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGWVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 1042 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 1043 - protein, 491 aa, Homo sapiens
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGESLARMELFLYLTAILQSFSLQPLGAPEDIDLTPLSSGLGNLPRPFQLCLRPR

SEQ ID NO: 1044 - protein, 231 aa, Homo sapiens; identical to SEQ ID NO: 401

SEQ ID NO: 1045 - protein, 1331 aa, Homo sapiens
MRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 1046 - protein, 376 aa, Homo sapiens
MKEGMRVLTQLVATYPQGFKIWMNPITPIIRLCHPNIIWSVINASATIAPKDEAFYKFLKPWLGDGLLVNASDKWSCHRQMLMPAFHFNMLKPYMKFFTDSVNIMHAKWQLLASGGSAHLDMFEHTSLMTLDSVQKCVFSFDSHCQDGWRFRRACCLVHDFTEAIIQEQRHTLTSQGVDYFHEVKAKSKTLDFTDVLLLSKDEDWKELSDEEIRAEADTFMFEDECPSHNTTASGLSWVLYYLARHPEYQEHCWDDLAQLPFLTMYIKDSLWLHPPVPVISRCCTQDIVYDPFRFDPENSKERSPLAFIPFSAGSRQGNCIGQAFAMAEMKVVLALTLLCFRVCPDHMEPRRKPEVIMYAEGGLWLWVKPLSADPQ

SEQ ID NO: 1047 - protein, 609 aa, Homo sapiens
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADHRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 1048 - protein, 372 aa, Homo sapiens
MRSVLRQRILKPKDVAIYSGEVNQVIADLIKRIYLLRSQAEDGETVTNVNDLFFKYSMEGVATILYESRLGCLENSIPQLTVEYIEALELMFSMFKTSMYAGAIPRWLRPFIPKPWREFCRSWDGLFKFSQIHVDNKLRDIQYQMDRGRRVSGGLLTYLFLSQALTLQEIYANVTEMLLAGVDTTSFTLSWTVYILARHPEVQQTVYREIVKNLGERHVPTAADVPKVPLVRALLKETLRLFPVLPGNGRVTQEDLVIGGYLIPKGTQLALCHYATSYQDENFPRAKEFRPERWLRKGDLDRVDNFGSIPFGHGVRSCIGRRIAELEIHLVVIQLLQHFEIKTSSQTNAVHAKTHGLLTPGGPIHVRFVNRK

SEQ ID NO: 1049 - protein, 549 aa, Homo sapiens
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATVVKERGKNRKKVLTLLGLSSLVGVTWGLAIFTPLGLSTVYIFALFNSLQGVFICCWFTILYLPSQSTTVSSSTARLDQAHSASQE

SEQ ID NO: 1050 - protein, 159 aa, Homo sapiens
MENVSALSLLTVESPTSMFDYCDDSLERVKSALDIFSMIIYTVTFFLGLAGNGLVIWVVGFHMSCTVNTVLATVVTTFFLCWLPLQVSLWLDFTSFREDREGLNQVALLLRPLALSMAFINSCLNPVLYVFIGHDFWEHLLHSLLAALERALSEEPDSA

SEQ ID NO: 1051 - protein, 111 aa, Homo sapiens
MFSPLSNRGGSSLISDLRRTDCREIQNTSVKAENYNVTSEELKWIHPKSRAKYQPLSWAPRRTESGDARIPECKCGAMTAITHVCTLKPEGWKPQPMSLSLFSHVNSNLDQ

SEQ ID NO: 1052 - protein, 364 aa, Homo sapiens
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 1053 - protein, 364 aa, Homo sapiens
MAQQWSLQRLAGRHPQDSYEDSTQSSIFTYTNSNSTRGPFEGPNYHIAPRWVYHLTSVWMIFVVTASVFTNGLVLAATMKFKKLRHPLNWILVNLAVADLAETVIASTISIVNQVSGYFVLGHPMCVLEGYTVSLCGITGLWSLAIISWERWLVVCKPFGNVRFDAKLAIVGIAFSWIWSAVWTAPPIFGWSRYWPHGLKTSCGPDVFSGSSYPGVQSYMIVLMVTCCIIPLAIIMLCYLQVWLAIRAVAKQQKESESTQKAEKEVTRMVVVMIFAYCVCWGPYTFFACFAAANPGYAFHPLMAALPAYFAKSATIYNPVIYVFMNRQFRNCILQLFGKKVDDGSELSSASKTEVSSVSSVSPA

SEQ ID NO: 1054 - protein, 375 aa, Homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 1055 - protein, 348 aa, Homo sapiens
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSRFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 1056 - protein, 574 aa, Homo sapiens
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 1057 - protein, 357 aa, Homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 1058 - protein, 369 aa, Homo sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 1059 - protein, 404 aa, Homo sapiens
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 1060 - protein, 380 aa, Homo sapiens
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 1061 - protein, 484 aa, Homo sapiens
MYDDSYVPGFEDSEAGSADSYTSRPSLDSDVSLEEDRESARREVESQAQQQLERAKHKPVAFAVRTNVSYCGVLDEECPVQGSGVNFEAKDFLHIKEKYSNDWWIGRLVKEGGDIAFIPSPQRLESIRLKQEQKARRSGNPSSLSDIGNRRSPPPSLAKQKQKQAEHVPPYDVVPSMRPVVLVGPSLKGYEVTDMMQKALFDFLKHRFDGRISITRVTADLSLAKRSVLNNPGKRTIIERSSARSSIAEVQSEIERIFELAKSLQLVVLDADTINHPAQLAKTSLAPIIVFVKVSSPKVLQRLIRSRGKSQMKHLTVQMMAYDKLVQCPPESFDVILDENQLEDACEHLAEYLEVYWRATHHPAPGPGLLGPPSAIPGLQNQQLLGERGEEHSPLERDSLMPSDEASESSRQAWTGSSQRSSRHLEEDYADAYQDLYQPHRQHTSGLPSANGHDPQDRLLAQDSEHNHSDRNWQRNRPWPKDSY

SEQ ID NO: 1062 - protein, 2294 aa, Homo sapiens [sequence omitted]

SEQ ID NO: 1063 - protein, 230 aa, Homo sapiens
MGLGPAWVTQPCLVTDSQPDAELLSSRAPCLGRRCCWSPGRGGVGGSGTTEPGDAALPCPGRVAQAPPRRLLLLLPLLLGRGLRVTAEASASSSGAAVENSSAMEELVTEKEAEESHRPDSVSLLTFILLLTLAILTIWLFKYCRVHFLHETGLAMICGLIVGVILRYGTPGTRGRDKLLNCTQEDQAFSTLVVDVSGKFFEYTLKREISPGKINSVKQNDMLGKVTFDP

SEQ ID NO: 1064 - protein, 427 aa, Homo sapiens
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 1065 - protein, 170 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRPLREKMKPERRRPKGRGKRRREKQRPTDCHLCGDAVPRR

SEQ ID NO: 1066 - protein, 409 aa, Homo sapiens
MRFTFPLMAIVLEIAMIVLFGLFVEYETDQTVLEQLNITKPTDMGIFFELYPLFQDVHVMIFVGFGFLMTFLKKYGFSSVGINLLVAALGLQWGTIVQGILQSQGQKFNIGIKNMINADFSAATVLISFGAVLGKTSPTQMLIMTILEIVFFAHNEYLVSEIFKASDIGASMTIHAFGAYFGLAVAGILYRSGLRKGHENEESAYYSDLFAMIGTLFLWMFWPSFNSAIAEPGDKQCRAIVDTYFSLAACVLTAFAFSSLVEHRGKLNMVHIQNATLAGGVAVGTCADMAIHPFGSMIIGSIAGMVSVLGYKFLTPLFTTKLRIHDTCGVHNLHGLPGVVGGLAGIVAVAMGASNTSMAMQAAALGSSIGTAVVGGLMTGLILKLPLWGQPSDQNCYDDSVYWKVPKTR

SEQ ID NO: 1067 - protein, 324 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 1068 - protein, 533 aa, Homo sapiens
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 1069 - protein, 840 aa, Homo sapiens
MSAFRLWPGLLIMLGSLCHRGSPCGLSTHVEIGHRALEFLQLHNGRVNYRELLLEHQDAYQAGIVFPDCFYPSICKGGKFHDVSESTHWTPFLNASVHYIRENYPLPWEKDTEKLVAFLFGITSHMAADVSWHSLGLEQGFLRTMGAIDFHGSYSEAHSAGDFGGDVLSQFEFNFNYLARRWYVPVKDLLGIYEKLYGRKVITENVIVDCSHIQFLEMYGEMLAVSKLYPTYSTKSPFLVEQFQEYFLGGLDDMAFWSTNIYHLTSFMLENGTSDCNLPENPLFIACGGQQNHTQGSKMQKNDFHRNLTTSLTESVDRNINYTERGVFFSVNSWTPDSMSFIYKALERNIRTMFIGGSQLSQKHVSSPLASYFLSFPYARLGWAMTSADLNQDGHGDLVVGAPGYSRPGHIHIGRVYLIYGNDLGLPPVDLDLDKEAHRILEGFQPSGRFGSALAVLDFNVDGVPDLAVGAPSVGSEQLTYKGAVYVYFGSKQGGMSSSPNITISCQDIYCNLGWTLLAADVNGDSEPDLVIGSPFAPGGGKQKGIVAAFYSGPSLSDKEKLNVEAANWTVRGEEDFSWFGYSLHGVTVDNRTLLLVGSPTWKNASRLGHLLHIRDEKKSLGRVYGYFPPNGQSWFTISGDKAMGKLGTSLSSGHVLMNGTLKQVLLVGAPTYDDVSKVAFLTVTLHQGGATRMYALTSDAQPLLLSTFSGDRRFSRFGGVLHLSDLDDDGLDEIIMAAPLRIADVTSGLIGGEDGRVYVYNGKETTLGDMTGKCKSWITPCPEEKAQYVLISPEASSRFGSSLITVRSKAKNQVVIAAGRSSLGARLSGALHVYSLGSD

SEQ ID NO: 1070 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 1071 - protein, 433 aa, Homo sapiens; identical to SEQ ID NO: 1070

SEQ ID NO: 1072 - protein, 343 aa, Homo sapiens
MNIHRSTPITIARYGRSRNKTQDFEELSSIRSAEPSQSFSPNLGSPSPPETPNLSHCVSCIGKYLLLEPLEGDHVFRAVHLHSGEELVCKVFDISCYQESLAPCFCLSAHSNINQITEIILGETKAYVFFERSYGDMHSFVRTCKKLREEEAARLFYQIASAVAHCHDGGLVLRDLKLRKFIFKDEERTRVKLESLEDAYILRGDDDSLSDKHGCPAYVSPEILNTSGSYSGKAADVWSLGVMLYTMLVGRYPFHDIEPSSLFSKIRRGQFNIPETLSPKAKCLIRSILRREPSERLTSQEILDHPWFSTDFSVSNSAYGAKEVSDQLVPDVNMEENLDPFFN

SEQ ID NO: 1073 - protein, 1088 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKNAGQVVSPQSAPACVENKNDVSRENSTVDFSKVDLHFMKKIPPGAEASNILLGELEFLDRTVVAFVRLSPAVLLQGLAEVPIPTRFLFILLGPLGKGQQYHEIGRSIATLMTDEVFHDVAYKAKDRNDLVSGIDEFLDQVTVLPPGEWDPSIRIEPPKNVPSQEKRKIPAVPNGTAAHGEAEPHGGHSGPELQRTGRIFGGLILDIKRKAPYFWSDFRDAFSLQCLASFLFLYCACMSPVITFGGLLGEATEGRISAIESLFGASMTGIAYSLFGGQPLTILGSTGPVLVFEKILFKFCKEYGLSYLSLRASIGLWTATLCIILVATDASSLVCYITRFTEEAFASLICIIFIYEALEKLFELSEAYPINMHNDLELLTQYSCNCVEPHNPSNGTLKEWRESNISASDIIWENLTVSECKSLHGEYVGRACGHDHPYVPDVLFWSVILFFSTVTLSATLKQFKTSRYFPTKVRSIVSDFAVFLTILCMVLIDYAIGIPSPKLQVPSVFKPTRDDRGWFVTPLGPNPWWTVIAAIIPALLCTILIFMDQQITAVIINRKEHKLKKGCGYHLDLLMVAVMLGVCSIMGLPWFVAATVLSITHVNSLKLESECSAPGEQPKFLGIREQRVTGLMIFILMGSSVFMTSILKFIPMPVLYGVFLYMGASSLKGIQFFDRIKLFWMPAKHQPDFIYLRHVPLRKVHLFTIIQMSCLGLLWIIKVSRAAIVSPMMVLSLVFVRKLMDLLFTKRELCWLDDLMPESKKKKLEYAEKEEEQCVLPMEDEGTVQLPLEGHYRDDPSVINISDEMSKTALWRNLLITADNSKDKESSFPSKSSPS

SEQ ID NO: 1074 - protein, 372 aa, Homo sapiens
MRVGPVRSAMSGASQPRGPALLFPATRGVPAKRLLDADDAAAVAAKCPRLSECSSPPDYLSPPGSPCSPQPPPAAPGAGGGSGSAPGPSRIADYLLLPLAEREHVSRALCIHTGRELRCKVFPIKHYQDKIRPYIQLPSHSNITGIVEVILGETKAYVFFEKDFGDMHSYVRSRKRLREEEAARLFKQIVSAVAHCHQSAIVLGDLKLRKFVFSTEERTQLRLESLEDTHIMKGEDDALSDKHGCPAYVSPEILNTTGTYSGKAADVWSLGVMLYTLLVGRYPFHDSDPSALFSKIRRGQFCIPEHISPKARCLIRSLLRREPSERLTAPEILLHPWFESVLEPGYIDSEIGTSDQIVPEYQEDSDISSFFC

SEQ ID NO: 1075 - protein, 308 aa, Homo sapiens
MEGAGGDPYRRPARRTQWLLSALAHHYGLDRGVENEIVVLATGLDQYLQEVFHHLDCRGAGRLPRADFRALCAVLGLRAEGATTAGQAAGDGNSRDVTPGDAAAELATDGDSDTDEEARLALRAEPPELTFRQFHARLCGYFGTRAGPRLPRGALSEHIETQIRLRHLWGSLWEKQRQVRNRQCGSHCGSGTHGPPSACGNQTRSGLLRRNHGVGLWKSQASTHEMGHGGPEAAVRELRQAQGALAAAEARAGRLRRGQAEVRRRAEEARQVVLRSLHRVRELEALAQQVPGLQRWVRRLEAELQRYR

SEQ ID NO: 1076 - protein, 329 aa, Homo sapiens
MNLLRRAWRRRAALGLGTLALCGAALLYLARCAAEPGDPRAMSGRSPPPPAPARAAAFLAVLVASAPRAAERRSVIRSTWLARRGAPGDVWARFAVGTAGLGAEERRALEREQARHGDLLLLPALRDAYENLTAKVLAMLAWLDEHVAFEFVLKADDDSFARLDALLAELRAREPARRRRLYWGFFSGRGRVKPGGRWREAAWQLCDYYLPYALGGGYVLSADLVHYLRLSRDYLRAWHSEDVSLGAWLAPVDVQREHDPRFDTEYRSRGCSNQYLVTHKQSLEDMLEKHATLAREGRLCKREVQLRLSYVYDWSAPPSQCCQRREGIP

SEQ ID NO: 1077 - protein, 166 aa, Homo sapiens
MNGYQGDCSCCSRQCTQKPEEGSLLRESLAGIPARAVPSQRASLKPSLPHARSSSPPCSCQGQLSHGHVWLCPLTWLPNPVVYLMKAFDLLVDRPATLVRVYRVAARKEQVELGQGSGAFTQVAKAYQDRYQDLGAHHSARKCRAKHKQRMLEERKAAKEATAAAS

SEQ ID NO: 1078 - protein, 162 aa, Homo sapiens
MPRADCIMRHLPYFCRGQVVRGFGRGSKQLGIPTANFPEQVVDNLPADISTGIYYGWASVGSGDVHKMVVSIGWNPYYKNTKKSMETHIMHTFKEDFYGEILNVAIVGYLRPEKNFDSLESLISAIQGDIEEAKKRLELPEHLKIKEDNFFQVSKSKIMNGH

SEQ ID NO: 1079 - protein, 1649 aa, Homo sapiens
MESVEKDWGWGLWRNLRCLGHAHQGKCCTEGGISSTTKTSSENGSCCFEKAARKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQMSIRVTRKSYKVSTSGPQAFNSLSYTSGPGACISSSSFSRMGSSSFRGGLGAGYGGASGGITTITVNQSLLSPLNLEVDPNIQAVRTQEEKQIKTLNNKFFSFIDKVRFLEQQNKMLETKWSLVQQQKMARSNMDNMFESYINNLKWQLETLGQEKLKLEAELGNMHGLVEDFRNKYEVEISKCTEMENEFVLIKEYVDEAYMNKMELESSLKELTAKISFLRQLYEEEIGSCSPRSRIHLWCCSWTTAASWTWTASSLRSRPEGFPGGCHADTEQRGELAIKDANAKLSELEAALQLASQDMARQLREYQELMNVKLALDIKIATYRKLLEGEESWLESGMQNMSIHMKTTSSYAGGQSLAYGGLTSPGLSYGLGSSFGSGMGSSSFSHTSSSRAVVMKKIETRDGKLVSESSNVLPNLRITATLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 1080 - protein, 711 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 1081 - protein, 525 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRHSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPRPFHCRQIGSVYRLPPLRKGEVLPLPEANFPSFPLPHHKHPLKPDNQPFPQSVSESCPGKFKSGFPQVSMFFTHTFPK

SEQ ID NO: 1082 - protein, 393 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLDSSDVERLERFFDSEDEDFEILSL

SEQ ID NO: 1083 - protein, 380 aa, Homo sapiens
MDAATLTYDTLRFAEFEDFPETSEPVWILGRKYSIFTEKDEILSDVASRLWFTYRKNFPAIGGTGPTSDTGWGCMLRCGQMIFAQALVCRHLGRDWRWTQRKRQPDSYFSVLNAFIDRKDSYYSIHQIAQMGVGEGKSIGQWYGPNTVAQVLKKLAVFDTWSSLAVHIAMDNTVVMEEIRRLCRTSVPCAGATAFPADSDRHCNGFPAGAEVTNRPSPWRPLVLLIPLRLGLTDINEAYVETLKHCFMMPQSLGVIGGKPNSAHYFIGYVGEELIYLDPHTTQPAVEPTDGCFIPDESFHCQHPPCRMSIAELDPSIAVGFFCKTEDDFNDWCQQVKKLSLLGGALPMFELVELQPSHLACPDVLNLSLGESCQVQILLM

SEQ ID NO: 1084 - protein, 695 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 1085 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 1086 - protein, 751 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 1087 - protein, 309 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 1088 - protein, 1646 aa, Homo sapiens
MGSQALQEWGQREPGRWPDPAGKKDVRREASDSGRAGTWPRTAKEKLKIDGDTRLPSSPQRFLRGCGDLHQKPKLELILSFGRCNSPPASSAVPGRDCREEAAQRCRQGSSCRRCGRDYLAARRGPSECSPREKMAAAAGNRASSSGFPGARATSPEAGGGGGALKASSAPAAAAGLLREAGSGGRERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 1089 - protein, 1025 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 1090 - protein, 741 aa, Homo sapiens
MESRDHNNPQEGPTSSSGRRAAVEDNHLLIKAVQNEDVDLVQQLLEGGANVNFQEEEGGWTPLHNAVQMSREDIVELLLRHGADPVLRKKNGATPFILAAIAGSVKLLKLFLSKGADVNECDFYGFTAFMEAAVYGKVKALKFLYKRGANVNLRRKTKEDQERLRKGGATALMDAAEKGHVEVLKILLDEMGADVNACDNMGRNALIHALLSSDDSDVEAITHLLLDHGADVNVRGERGKTPLILAVEKKHLGLVQRLLEQEHIEINDTDSDGKTALLLAVELKLKKIAELLCKRGASTDCGDLVMTARRNYDHSLVKVLLSHGAKEDFHPPAEDWKPQSSHWGAALKDLHRIYRPMIGKLKFFIDEKYKIADTSEGGIYLGFYEKQEVAVKTFCEGSPRAQREVSCLQSSRENSHLVTFYGSESHRGHLFVCVTLCEQTLEACLDVHRGEDVENEEDEFARNVLSSIFKAVQELHLSCGYTHQDLQPQNILIDSKKAAHLADFDKSIKWAGDPQEVKRDLEDLGRLVLYVVKKGSISFEDLKAQSNEEVVQLSPDEETKDLIHRLFHPGEHVRDCLSDLLGHPFFWTWESRYRTLRNVGNESDIKTRKSESEILRLLQPGPSEHSKSFDKWTTKINECVMKKMNKFYEKRGNFYQNTVGDLLKFIRNLGEHIDEEKHKKMKLKIGDPSLYFQKTFPDLVIYVYTKLQNTEYRKHFPQTHSPNKPQCDGAGGASGLASPGC

SEQ ID NO: 1091 - protein, 552 aa, Homo sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 1092 - protein, 616 aa, Homo sapiens
MAPRARRRRPLFALLLLCALLARLQVALQIAPPCTSEKHYEHLGRCCNKCEPGKYMSSKCTTTSDSVCLPCGPDEYLDSWNEEDKCLLHKVCDTGKALVAVVAGNSTTPRRCACTAGYHWSQDCECCRRNTECAPGLGAQHPLQLNKDTVCKPCLAGYFSDAFSSTDKCRPWTNCTFLGKRVEHHGTEKSDAVCSSSLPARKPPNEPHVYLPGLIILLLFASVALVAAIIFGVCYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 1093 - protein, 626 aa, Homo sapiens
MVDVVGLERETGPRGSPWPGLPLPSLVGPAPLLTCLCPQCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGAYTSQSRPPVQDQLSQSERYLYGSLATLLICLCAVFGLLLLTCTGCRGVAHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLTWHSRLESARRARPGSWQWPPACSLRSTLRHAPGDVESTGPAAPGSSSCCTTWACWAAGPSCCCCPCTRMTSPSDTLP

SEQ ID NO: 1094 - protein, 647 aa, Homo sapiens
MASLVSLELGLLLAVLVVTATASPPAGLLSLLTSGQGALDQEALGGLLNTLADRVHCTNGPCGKCLSVEDALGLGEPEGSGLPPGPVLEARYVARLSAAAVLYLSNPEGTCEDTRAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVAHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 1095 - protein, 169 aa, Homo sapiens
MAALLLRHVGRHCLRAHFSPQLCIRNAVPLGTTAKEEMERFWNKNIGSNRPLSPHITIYSWSLPMAMSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 1096 - protein, 264 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 1097 - protein, 372 aa, Homo sapiens
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 1098 - protein, 272 aa, Homo sapiens
MVLLTAVLLLLAAYAGPAQSLGSFVHCEPCDEKALSMCPPSPLGCELVKEPGCGCCMTCALAEGQSCGVYTERCAQGLRCLPRQDEEKPLHALLHGRGVCLNEKSYREQVKIERDSREHEEPTTSEMAEETYSPKIFRPKHTRISELKAEAVKKDRRKKLTQSKFVGGAENTAHPRIISAPEMRQESEQGPCRRHMEASLQELKASPRMVPRAVYLPNCDRKGFYKRKQCKPSRGRKRGICWCVDKYGMKLPGMEYVDGDFQCHTFDSSNVE

SEQ ID NO: 1099 - protein, 1516 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSTPVYDAIKLMKDISQNFPIKARSLTRIAVNQHMREEIKENQKDLQVRFKIQPGDARLFINGLRVDMDVYDAFSILDMLKLEGKMMNGLRNLGINGEDMSKFLKLNSHIWEYTYVLDIRHSSIMWINDLENDDLYITWPTSCQKLLKPVFPGSVPSIRRNFHNLVLFIDPAQEYTLDFIKLADVFYSHEVPLRIGFVFILNTDDEVDGANDAGVALWRAFNYIAEEFDISEAFISIVHMYQKVKKDQNILTVDNVKSVLQNTFPHANIWDILGIHSKYDEERKAGASFYKMTGLGPLPQALYNGEPFKHEEMNIKELKMAVLQRMMDASVYLQREVFLGTLNDRTNAIDFLMDRNNVVPRINTLILRTNQQYLNLISTSVTADVEDFSTFFFLDSQDKSAVIAKNMYYLTQDDESIISAVTLWIIADFDKPSGRKLLFNALKHMKTSVHSRLGIIYNPTSKINEENTAISRGILAAFLTQKNMFLRSFLGQLAKEEIATTIYSGDKIKTFLIEGMDKNAFEKKYNTVGVNIFRTHQLFCQDVLKLRPGEMGIVSNGRFLGPLDEDFYAEDFYLLEKITFSNLGEKIKGIVENMGINANNMSDFIMKVDALMSSVPKRASRYDVTFLRENHSVIKTNPQENDMFFNVIAIVDPLTREAQKMAQLLVVLGKIINLKIKLFMNCRGRLSEAPLESFYRFVLEPELMSGANDVSSLGPVAKFLDIPESPLLILNMITPEGWLVETVHSNCDLDNIHLKDTEKTVTAEYELEYLLLEGQCFDKVTEQPPRGLQFTLGTKNKPAVVDTIVMAHHGYFQLKANPGAWILRLHQGKSEDIYQIVGHEGTDSQADLEDIIVVLNSFKSKILKVKVKKETDKIKEDILTDEDEKTKGLWDSIKSFTVSLHKENKKEKDVLNIFSVASGHLYERFLRIMMLSVLRNTKTPVKFWLLKNYLSPTFKEVIPHMAKEYGFRYELVQYRWPRWLRQQTERQRIIWGYKILFLDVLFPLAVDKIIFVDADQIVRHDLKELRDFDLDGAPYGYTPFCDSRREMDGYRFWKTGYWASHLLRRKYHISALYVVDLKKFRRIGAGDRLRSQYQALSQDPNSLSNLDQDLPNNMIYQVAIKSLPQDWLWCETWCDDESKQRAKTIDLCNNPKTKESKLKAAARIVPEWVEYDAEIRQLLDHLENKKQDTILTHDEL

SEQ ID NO: 1100 - protein, 130 aa, Homo sapiens
MPIINLLLLIIPTLIAIAFLTIIERKILGYIHLRKGPNIVGACGLLQPFADAIKRFIQEPLQTSTSTSTITLYIIAPTLALSITLLCEHTPNSAMTNSYLLRKNFLSLTLAFCMSYISMPVLISSIPHQT

SEQ ID NO: 1101 - protein, 379 aa, Homo sapiens
MPDNIEESWKIMALDAIAKTCTFTAMCFENMRIMRYEEFISMIFRLDYTQPLSDEYITVTDTTFVDIPVRLYLPKRKSETRRRAVIYFHGGGFCFGSSKQRAFDFLNRWTANTLDAVVVGVDYRLAPQHHFPAQFEDGLAAVKFFLLEKILTKYGVDPTRICISGDSSGGNLATAVTQQVQNDAEIKHKIKMQVLLYPGLQITDSYLPSHRENEHGIVLTRDVAIKLVSLYFTKDEALPWAMRRNQHMPLESRHLFKFVNWSILLPEKYRKDYVYTEPILGGLSYSLPGLTDSRALPLLANDSQLQNLPLTYILTCQHDLLRDDGLMYVTRLRNVGVQVVHEHIEDGIHGALSFMTSPFYLRLGLRIRDMYVSWLDKNL

SEQ ID NO: 1102 - protein, 251 aa, Homo sapiens
MTRLTVLALLAGLLASSRAGSSPLLDIVGGRKARPRQFPFLASIQNQGRHFCGGALIHARFVMTAASCFQSQNPGVSTVVLGAYDLRRRERQSRQTFSISSMSENGYDPQQNLNDLMLLQLDREANLTSSVTILPLPLQNATVEAGTRCQVAGWGSQRSGGRLSRFPRFVNVTVTPEDQCRPNNVCTGVLTRRGGICNGDGGTPLVCEGLAHGVASFSLGPCGRGPDFFTRVALFRDWIDGVLNNPGPGPA

SEQ ID NO: 1103 - protein, 177 aa, Homo sapiens
MDLVKVRKRQNWRRTVEGWASEKQMVVVCKESPKEYLQPFKDKLEEFFQKGLPRQFWSIQRKGIYMRETGSYDREVKSSLRDKQNTKMGTSVANAKHPVKSERARSSPEHSCPCCQRLKVTERYKAEKQLPVLDKAMFLVLDHINLSELIKIIRRSFQLSANQAFLLAVNRHSIVAE

SEQ ID NO: 1104 - protein, 211 aa, Homo sapiens
MAPEVVVVFVDQATFYDKHCDLESLGMVLYIMLSGYLPFVGHCGANCGWDRGEVCRVCQKKLFESIQEGKYEFPDKDWAHISSLQSRQQRLLYGSIQAFSSTKALKFPPTPHFPRVLEEKAFSKGVVFEKESNHLSFCIIACSRNISSLGSTCSAACRSGIRCALTALAVAGAAACREKQEASVDRGCRPVPVPSLLCHPPLAVLPPSSVL

SEQ ID NO: 1105 - protein, 291 aa, Homo sapiens
MAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 1106 - protein, 465 aa, Homo sapiens
MPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLHWKNGDESLKTDEKISLSQFLIQKFHTTSRLAFYSSTGWYNRLYINFTLRRHIFFFLLQTYFPATLMVMLSWVSFWIDRRAVPARVSLGITTVLTMTTIITGVNASMPRVSYVKAVDIYLWVSFVFVFLSVLEYAAVNYLTTVQERKERKLREKFPCMCGMLHSKTMMLDGSYSESEANSLAGYPRSHILTEEERQDKIVVHLGLSGEANAARKKGLLKGQTGFRIFQNTHAIDKYSRLIFPASYIFFNLIYWSVFS

SEQ ID NO: 1107 - protein, 967 aa, Homo sapiens
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 1108 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 1109 - protein, 189 aa, Homo sapiens
MALTFYLLVALVVLSYKSFSSLGCDLPQTHSLGNRRALILLAQMRRISPFSCLKDRHDFEFPQEEFDDKQFQKAQAISVLHEMIQQTFNLFSTKDSSAALDETLLDEFYIELDQQLNDLESCVMQEVGVIESPLMYEDSILAVRKYFQRITLYLTEKKYSSCAWEVVRAEIMRSFSLSINLQKRLKSKE

SEQ ID NO: 1110 - protein, 177 aa, Homo sapiens
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 1111 - protein, 215 aa, Homo sapiens
MCTEGAFPHRSACSLPLTHVHTHIHVCVPVLWGSVPRGMKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 1112 - protein, 348 aa, Homo sapiens
MNDPNSCVDNATVCSGASCVVPESNFNNILSVVLSTVLTILLALVMFSMGCNVEIKKFLGHIKRPWGICVGFLCQFGIMPLTGFILSVAFDILPLQAVVVLIIGCCPGGTASNILAYWVDGDMDLSVSMTTCSTLLALGMMPLCLLIYTKMWVDSGSIVIPYDNIGTSLVALVVPVSIGMFVNHKWPQKAKIILKIGSIAGAILIVLIAVVGGILYQSAWIIAPKLWIIGTIFPVAGYSLGFLLARIAGLPWYRCRTVAFETGMQNTQLCSTIVQLSFTPEELNVVFTFPLIYSIFQLAFAAIFLGFYVAYKKCHGKNKAEIPESKENGTEPESSFYKANGGFQPDEK

SEQ ID NO: 1113 - protein, 522 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGSKTSLMIRHDKVLRSFDSMISTNCTEELENAGVEVLKFSQVKEVKKTLSGLEVSMVTAVPGRLPVMTMIPDVDCLLWAIGRVPNTKDLSLNKLGIQTDDKGHIIVDEFQNTNVKGIYAVGDVCGKALLTPVAIAAGRKLAHRLFEYKEDSKLDYNNIPTVVFSHPPIGTVGLTEDEAIHKYGIENVKTYSTSFTPMYHAVTKRKTKCVMKMVCANKEEKVVGIHMQGLGCDEMLQGFAVAVKMGATKADFDNTVAIHPTSSEELVTLR

SEQ ID NO: 1114 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 1115 - protein, 448 aa, Homo sapiens
MADYLITSSTGYVPRDGLTVPQLFVGADGLTHNDFLILPGFIDFIADEVDLTSALTQKVTLKTPLISSPMDTVTEADMAIAMALMGPIGFIHHNCTAEFQAKEVQKIKKFEQGFITDPVVLSPSRTVGDVLEAKMRHGFSGIPITRRAPSWWASSPPETLTFLLRRTTPPSSKNRDYPLASKDSHKQLLCRAAVGTREDDKYCLDLLFQAGLNSWTRPRELGTSDHHGALHQTKVPPPPGDWGEHGDSSPGQEPDAGVDGLLVGTGCGSICITQEVMACGRPQGTAMYKVAEYAWHFGVPIIFNGGIQIVEHMVKALALGASTVMTGSLLAATMEAPGEYFFSDGVWLKKYRGMGSLDAMGKSSSSQKRYFGEGDKVKIAQDVSNSIQDKGSIQNFVSYLIVDIQQGCQDSRAHSLSALWSMMYSGELKFEKWTILAQIKGGVHGLHS

SEQ ID NO: 1116 - protein, 1621 aa, Homo sapiens
MAKSGGCGAGAGVGGGNGALTWVNNAAKKEESETANKNDSSKKLSVERVYQKKTQLEHILLRPDTYIGSVEPLTQFMWVYDEDVGMNCREVTFVPGLYKIFDEILVNAADNKQRDKNMTCIKVSIDPESNIISIWNNGKGIPVVEHKVEKVYVPALIFGQLLTSSNYDDDEKKVTGGRNGYGAKLCNIFSTKFTVETACKEYKHSFKQTWMNNMMKTSEAKIKHFDGEDYTCITFQPDLSKFKMEKLDKDIVALMTRRAYDLAGSCRGVKVMFNGKKLPVNGFRSYVDLYVKDKLDETGVALKVIHELANERWDVCLTLSEKGFQQISFVNSIATTKGGRHVDYVVDQVVGKLIEVVKKKNKAGVSVKPFQVKNHIWVFINCLIENPTFDSQTKENMTLQPKSFGSKCQLSEKFFKAASNCGIVESILNWVKFKAQTQLNKKCSSVKYSKIKGIPKLDDANDAGGKHSLECTLILTEGDSAKSLAVSGLGVIGRDRYGVFPLRGKILNVREASHKQIMENAEINNIIKIVGLQYKKSYDDAESLKTLRYGKIMIMTDQDQDGSHIKGLLINFIHHNWPSLLKHGFLEEFITPIVKASKNKQELSFYSIPEFDEWKKHIENQKAWKIKYYKGLGTSTAKEAKEYFADMERHRILFRYAGPEDDAAITLAFSKKKIDDRKEWLTNFMEDRRQRRLHGLPEQFLYGTATKHLTYNDFINKELILFSNSDNERSIPSLVDGFKPGQRKVLFTCFKRNDKREVKVAQLAGSVAEMSAYHHGEQALMMTIVNLAQNFVGSNNINLLQPIGQFGTRLHGGKDAASPRYIFTMLSTLARLLFPAVDDNLLKFLYDDNQRVEPEWYIPIIPMVLINGAEGIGTGWACKLPNYDAREIVNNVRRMLDGLDPHPMLPNYKNFKGTIQELGQNQYAVSGEIFVVDRNTVEITELPVRTWTQVYKEQVLEPMLNGTDKTPALISDYKEYHTDTTVKFVVKMTEEKLAQAEAAGLHKVFKLQTTLTCNSMVLFDHMGCLKKYETVQDILKEFFDLRLSYYGLRKEWLVGMLGAESTKLNNQARFILEKIQGKITIENRSKKDLIQMLVQRGYESDPVKAWKEAQEKAAEEDETQNQHDDSSSDSGTPSGPDFNYILNMSLWSLTKEKVEELIKQRDAKGREVNDLKRKSPSDLWKEDLAAFVEELDKVESQEREDVLAGMSGKAIKGKVGKPKVKKLQLEETMPSPYGRRIIPEITAMKADASKKLLKKKKGDLDTAAVKVEFDEEFSGAPVEGAGEEALTPSVPINKGPKPKREKKEPGTRVRKTPTSSGKPSAKKVKKRNPWSDDESKSESDLEETEPVVIPRDSLLRRAAAERPKYTFDFSEEEDDDADDDDDDNNDLEELKVKASPITNDGEDEFVPSDGLDKDEYTFSPGKSKATPEKSLHDKKSQDFGNLFSFPSYSQKSEDDSAKFDSNEEDSASVFSPSFGLKQTDKVPSKTVAAKKGKPSSDTVPKPKRAPKQKKVVEAVNSDSDSEFGIPKKTTTPKGKGRGAKKRKASGSENEGDYNPGRKTSKTTSKKPKKTSFDQDSDVDIFPSDFPTEPPSLPRTGRARKEVKYFAESDEEEDDVDFAMFN

SEQ ID NO: 1117 - protein, 655 aa, Homo sapiens
MERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSSQNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 1118 - protein, 680 aa, Homo sapiens
MLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEWMQNVLGQVLDALEYLHHLDIIHRNLKPSNIILISSDHCKLQDLSSNVLMTDKAKWNIRAEEDPFRKSWMAPEALNFSFSQKSDIWSLGCIILDMTSCSFMDGTEAMHLRKSLRQSPGSLKAVLKTMEEKQIPDVETFRNLLPLMLQIDPSDRITIKDVVHITFLRGSFKSSCVSLTLHRQMVPASITDMLLEGNVASILEVMQKFSGWPEVQLRAMKRLLKMPADQLGLPWPPELVEVVVTTMELHDRVLDVQLCACSLLLHLLGQALVHHPEAKAPCNQAITSTLLSALQSHPEEEPLLVMVYSLLAITTTQESESLSEELQNAGLLEHILEHLNSSLKSRDVCASGLGLLWALLLDGIIVNKAPLEKVPDLISQVLATYPADGEMAEASCGVFWLLSLLGCIKEQQFEQVVALLLQSIRLCQDRALLVNNAYRGLASLVKVSELAAFKVVVQEEGGSGLSLIKETYQLHRDDPEVVENVGMLLVHLASYEEILPELVSSSMKALLQEIKERFTSSLVSDSSAFSKPGLPPGGSPQLGCTTSGGLE

SEQ ID NO: 1119 - protein, 508 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 1120 - DNA, 2269 bp, Homo sapiens
ggtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacagctttaccacatttcttcatgggatattacaggtattctaaagaaaccaatattgatccatcagaaaattcaacatcaaacttaccaaactgtttaattaatcaaatgttatcactcaatagaacaccgtctgagataatagaaagaggttgtgtgaaggaatctgggtcacacatgtggatctatgtcttcatgggtaatatgcttcgtggcataggggaaacccccatagtaccattggggatttcttacattgatgattttgcaaaagaaggacattcttccttgtatttaggtactgtgaatgcaatgggaatgactggtctagtttttgcctttatgctgggatctctgtttgctaaaatgtatgtggatatcggatatgtggatctgagcactatcaggataactcctaaggactctcgttgggttggagcttggtggcttggtttccttgtgtctggaatagtatccattatttcttctataccattctttttcttgcctctaaatccaaataaaccacagaaagaaaggaaagtttcactatttttgcatgtgctaaaaactaatgataaaaggaatcaaatagctaatttgaccaaccgaagaaaatatattaccaaaaatgtgactggctttttccagtctttgaaaagcatccttaccaatcccctgtatgttatatttgtaatttttacattgttacacatgagcagctacattgcttctcttacttatatcattaaaatggtggagcaacagtatggttggtctgcatctaagactaactttttgttgggagtcctcgccctacctactgttgcaattggcatgttttcaggaggatatatcattaaaaaattcaaattgtctttagttggacttgccaaattggcattttgttctgcaacagtgcatctcttatctcaagttttatatttctttctaatctgtgaaagcaaatcagttgccggcctaaccttgacctatgatggaaatagtccagtaagatctcatgtagatgtaccactttcttattgcaactcagagtgcaattgtgatgaaagtcaatgggaacccgtctgtggaaacaatggaataacttacctgtcaccttgtctagcaggatgcaaatcttcaagtggtaataaagagcccatagtgttttataactgtagctgtgtggaagtaattggtctccagaacaaaaattactcagcgcacttgggtgaatgcccaagagatgatgcttgtacaaggaaatcttacgtttattttgtaattcaagtcttagatgctttcctctgtgcagttggacttacctcatattccgtgctggtgattaggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaaagcatgtaattaagaggaggaaaaaaataactttgctgctgtttccaactaatgtattgattccataagacgttatttttgtggtgttctgagtcttttcactgagaattcccacattcctcacttatgatgcaacgat

SEQ ID NO: 1121 - DNA, 480 bp, Homo sapiens
atggtcaaccccaccaagttcttcaatgagccctggggccgcatctccatccagctgtttgcagacaagtttccaaagacagcagaaaatgtttgtgctctgagcattggagagaaaggatttggttataagggttcctgctttcacagaattattccggggtttatgtgtcacggtggtgacttcacacaccataatggcagtggtggcaagtacatctatggggagaaatttgatgatgagaacttcatcctgaagcagacaggttctggcatcttgtccaaggaaaatgctggacccaacacaaacggttcccagtttttcatctgcagtgccaagagtgagtggttggatggtgagcatgtgttctttggcaaggtgaaagaaggcatgaatattgtggaggccatggagggttttgggtccaggaatggcaagaccagcaagaagatcaccattgctgactgttgacaactctaa

SEQ ID NO: 1122 - DNA, 773 bp, Homo sapiens
aagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaag

SEQ ID NO: 1123 - protein, 473 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 1124 - protein, 890 aa, Homo sapiens; identical to SEQ ID NO: 872

SEQ ID NO: 1125 - protein, 1315 aa, Homo sapiens [sequence omitted]

SEQ ID NO: 1126 - protein, 570 aa, Homo sapiens [sequence omitted]

SEQ ID NO: 1127 - protein, 1036 aa, Homo sapiens
MALRGAAGATDTPVSSAGGAPGGSASSSSTSSGGSASAGAGLWAALYDYEARGEDELSLRRGQLVEVLSQDAAVSGDEGWWAGQVQRRLGIFPANYVAPCRPAASPAPPPSRPSSPVHVAFERLELKELIGAGGFGQVYRATWQGQEVAVKAARQDPEQDAAAAAESVRREARLFAMLRHPNIIELRGVCLQQPHLCLVLEFARGGALNRALAAANAAPDPRAPGPRRARRIPPHVLVNWAVQIARGMLYLHEEAFVPILHRDLKSSNILLLEKIEHDDICNKTLKITDFGLAREWHRTTKMSTAGTYAWMAPEVIKSSLFSKGSDIWSYGVLLWELLTGEVPYRGIDGLAVAYGVAVNKLTLPIPSTCPEPFAKLMKECWQQDPHIRPSFALILEQLTAIEGAVMTEMPQESFHSMQDDWKLEIQQMFDELRTKEKELRSREEELTRAALQQKSQEELLKRREQQLAEREIDVLERELNILIFQLNQEKPKVKKRKGKFKRSRLKLKDGHRISLPSDFQHKITVQASPNLDKRRSLNSSSSSPPSSPTMMPRLRAIQLTSDESNKTWGRNTVFRQEEFEDVKRNFKKKGCTWGPNSIQMKDRTDCKERIRPLSDGNSPWSTILIKNQKTMPLASLFVDQPGSCEEPKLSPDGLEHRKPKQIKLPSQAYIDLPLGKDAQRENPAEAESWEEAASANAATVSIEMTPTNSLSRSPQRKKTESALYGCTVLLASVALGLDLRELHKAQAAEEPLPKEEKKKREGIFQRASKSRRSASPPTSLPSTCGEASSPPSLPLSSALGILSTPSFSTKCLLQMDSEDPLVDSAPVTCDSEMLTPDFCPTAPGSGREPALMPRLDTDCSVSRNLPSSFLQQTCGNVPYCASSKHRPSHHRRTMSDGNPTPTGATIISATGASALPLCPSPAPHSHLPREVSPKKHSTVHIVPQRRPASLRSRSDLPQAYPQTAVSQLAQTACVVGRPGPHPTQFLAAKERTKSHVPSLLDADVEGQSRDYTVPLCRMRSKTSRPSIYELEKEFLS

SEQ ID NO: 1128 - protein, 252 aa, Homo sapiens
MQMARLLGLCAWARKSVRMASSRMTRRDPLTNKVALVTASTDGIGFAIARRLAQDRAHVVVSSRKQQNVDQAVATLQGEGLSVTGTVCHVGKAEDRERLVAMAVKLHGGIDILVSNAAVNPFFGSLMDVTEEVWDKGFSPYNVSKTALLGLNNTLAIELAPRNIRVNCLHLDLSRLASAGWLGEPEDCAGIVSFLCSEDASYITGETVVNLSVMFTGGGVCRAASWKEGGTGTPRTPRESPRQREPGESGEG

SEQ ID NO: 1129 - protein, 503 aa, Homo sapiens
MALIPDLAMETRLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGCETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 1130 - protein, 491 aa, Homo sapiens [sequence omitted]

SEQ ID NO: 1131 - protein, 1244 aa, Homo sapiens
MSGGGEQLDILSVGILVKERWKVLRKIGGGGFGEIYDALDMLTRENVALKVESAQQPKQVLKMEVAVLKKLQGKDHVCRFIGCGRNDRFNYVVMQLQGRNLADLRRSQSRGTFTISTTLRLGRQILESIESIHSVGFLHRDIKPSNFAMGRFPSTCRKCYMLDFGLARQFTNSCGDVRPPRAVAGFRGTVRYASINAHRNREMGRHDDLWSLFYMLVEFVVGQLPWRKIKDKEQVGSIKERYDHRLMLKHLPPEFSIFLDHISSLDYFTKPDYQLLTSVFDNSIKTFGVIESDPFDWEKTGNDGSLTTTTTSTTPQLHTRLTPAAIGIANATPIPGDLLRENTDEVFPDEQLSDGENGIPVGVSPDKLPGSLGHPRPQEKDVWEEMDANKNKIKLGICKAATEEENSHGQANGLLNAPSLGSPIRVRSEITQPDRDIPLVRKLRSIHSFELEKRLTLEPKPDTDKFLETCLEKMQKDTSAGKESILPALLHKPCVPAVSRTDHIWHYDEEYLPDASKPASANTPEQADGGGSNGFIAVNLSSCKQEIDSKEWVIVDKEQDLQDFRTNEAVGHKTTGSPSDEEPEVLQVLEASPQDEKLQLGPWAENDHLKKETSGVVLALSAEGPPTAASEQYTDRLELQPGAASQFIAATPTSLMEAQAEGPLTAITIPRPSVASTQSTSGSFHCGQQPEKKDLQPMEPTVELYSPRENFSGLVVTEGEPPSGGSRTDLGLQIDHIGHDMLPNIRESNKSQDLGPKELPDHNRLVVREFENLPGETEEKSILLESDNEDEKLSRGQHCIEISSLPGDLVIVEKDHSATTEPLDVTKTQTFSVVPNQDKNNEIMKLLTVGTSEISSRDIDPHVEGQIGQVAEMQKNKISKDDDIMSEDLPGHQGDLSTFLHQEGKREKITPRNGELFHCVSENEHGAPTRKDMVRSSFVTRHSRIPVLAQEIDSTLESSSPVSAKEKLLQKKAYQPDLVKLLVEKRQFKSFLGDLSSASDKLLEEKLATVPAPFCEEEVLTPFSRLTVDSHLSRSAEDSFLSPIISQSRKSKIPRPVSWVNTDQVNSSTSSQFFPRPPPGKPPTRPGVEARLRRYKVLGSSNSDSDLFSRLAQILQNGSQKPRSTTQCKSPGSPHNPKTPPKSPVVPRRSPSASPRSSSLPRTSSSSPSRAGRPHHDQRSSSPHLGRSKSPPSHSGSSSSRRSCQQEHCKPSKNGLKGSGSLHHHSASTKTPQGKSKPASKLSR

SEQ ID NO: 1132 - protein, 655 aa, Homo sapiens
MERKVLALQARKKRTKAKKDKAQRKSETQHRGSAPHSESDLPEQEEEILGSDDDEQEDPNDYCKGGYHLVKIGDLFNGRYHVIRKLGWGHFSTVWLSWDIQGKKFVAMKVVKSAEHYTETALDEIRLLKSVRNSDPNDPNREMVVQLLDDFKISGVNGTHICMVFEVLGHHLLKWIIKSNYQGLPLPCVKKIIQQVLQGLDYLHTKCRIIHTDIKPENILLSVNEQYIRRLAAEATEWQRSGAPPPSGSAVSTAPQPKPADKMSKNKKKKLKKKQKRQAELLEKRMQEIEEMEKESGPGQKRPNKQEESESPVERPLKENPPNKMTQEKLEESSTIGQDQTLMERDTEGGAAEINCNGVIEVINYTQNSNNETLRHKEDLHNANDCDVQNLNQESSFLSLPNGDSSTSQETDSCTPITSEVSDTMVCQSSSTVGQSFSEQHISQLQESIRAEIPCEDEQEQEHNGPLDNKGKSTAGNFLVNPLEPKNAEKLKVKIADLGNACWVHKHFTEDIQTRQYRSLEVLIGSGYNTPADIWSTACMAFELATGDYLFEPHSGEEYTRDEDHIALIIELLGKVPRKLIVAGKYSKEFFTKKGDLKHITKLKPWGLFEVLVEKYEWSQEEAAGFTDFLLPMLELIPEKRATAAECLRHPWLNS

SEQ ID NO: 1133 - protein, 632 aa, Homo sapiens
MLGPGSNRRRPTQGERGPGSPGEPMEKYQVLYQLNPGALGVNLVVEEMETKVKHVIKQVECMDDHYASQALEELMPLLKLRHAHISVYQELFITWNGEISSLYLCLVMEFNELSFQEVIEDKRKAKKIIDSEWMQNVLGQVLDALEYLHHLDIIHRNLKPSNIILISSDHCKLQDLSSNVLMTDKAKWNIRAEEDPFRKSWMAPEALNFSFSQKSDIWSLGCIILDMTSCSFMDGTEAMHLRKSLRQSPGSLKAVLKTMEEKQIPDVETFRNLLPLMLQIDPSDRITIKDVVHITFLRGSFKSSCVSLTLHRQMVPASITDMLLEGNVASILGDAGDTKGERALKLLSMALASYCLVPEGSLFMPLALLHMHDQWLSCDQDRVPGKRDFASLGKLGKLLGPIPKGLPWPPELVEVVVTTMELHDRVLDVQLCACSLLLHLLGQGIIVNKAPLEKVPDLISQVLATYPADGEMAEASCGVFWLLSLLGCIKEQQFEQVVALLLQSIRLCQDRALLVNNAYRGLASLVKVSELAAFKVVVQEEGGSGLSLIKETYQLHRDDPEVVENVGMLLVHLASYEEILPELVSSSMKALLQEIKERFTSSLELVSCAEKVLLRLEAATSPSPLGGEAAQP

We claim:

1. A method for identifying a compound that induces differentiation of undifferentiated vertebrate cells into osteoblasts, comprising (a) contacting a compound with a polypeptide consisting of an amino acid sequence of SEQ ID NO: 379, in an in vitro cell-free preparation; (b) measuring the binding affinity of said compound to said polypeptide; and (c) selecting a compound for confirmation as an inducer of vertebrate cell differentiation into osteoblasts, which compound is selected based on its binding affinity for the polypeptide of SEQ ID NO. 379.

2. A method according to claim 1 for identifying a compound that induces differentiation of undifferentiated mammalian vertebrate cells into osteoblasts, said method further comprising c) contacting said compound selected to have binding affinity to, and capable of forming a complex with, said polypeptide of SEQ ID NO: 379 with a undifferentiated mammalian vertebrate cell, which is in culture, and in which said polypeptide comprising the amino acid sequence of SEQ ID NO: 379 is expressed; and (d) measuring in said culture levels of at least one biochemical marker indicative of the differentiation of said undifferentiated mammalian vertebrate cells; and (e) determining if said levels of said one or more biochemical marker indicative of the differentiation of said undifferentiated mammalian vertebrate cells are decreased as compared to levels of said biochemical marker expressed in said undifferentiated mammalian vertebrate cell that is not contacted with said compound; and (f) selecting a compound, based on its decrease in biochemical marker level, for confirmation as an inducer of vertebrate cell differentiation into osteoblasts.

3. The method according to claim 2, wherein said biochemical marker is bone alkaline phosphatase.

4. The method according to claim 2 wherein said compound having binding affinity to, and capable of forming a complex with, said polypeptide of SEQ ID NO: 379 exhibits a binding affinity of at least 10 micromolar.

5. The method according to claim 4, wherein said undifferentiated mammalian vertebrate cell is an osteoblast progenitor cell.

* * * * *

UNITED STATES PATENT AND TRADEMARK OFFICE
CERTIFICATE OF CORRECTION

PATENT NO.       : 7,638,288 B2                                Page 1 of 1
APPLICATION NO.  : 11/478193
DATED            : December 29, 2009
INVENTOR(S)      : Van Rompaey et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 321 days.

Signed and Sealed this

Twelfth Day of October, 2010

David J. Kappos
*Director of the United States Patent and Trademark Office*